United States Patent
Kaser

(10) Patent No.: US 6,727,066 B2
(45) Date of Patent: Apr. 27, 2004

(54) GENES EXPRESSED IN TREATED HUMAN C3A LIVER CELL CULTURES

(75) Inventor: Matthew R. Kaser, Castro Valley, CA (US)

(73) Assignee: Incyte Corporation, Palo Alto, CA (US)

( * ) Notice: Subject to any disclaimer, the term of this patent is extended or adjusted under 35 U.S.C. 154(b) by 43 days.

(21) Appl. No.: 09/919,039

(22) Filed: Jul. 30, 2001

(65) Prior Publication Data

US 2003/0108871 A1 Jun. 12, 2003

Related U.S. Application Data

(60) Provisional application No. 60/222,113, filed on Jul. 28, 2000.

(51) Int. Cl.[7] .......................... C12Q 1/68; C12N 15/00; C12N 15/63; C12N 1/20; C07H 21/04
(52) U.S. Cl. ..................... 435/6; 435/320.1; 435/252.8; 435/174; 435/183; 382/129; 382/133; 382/153; 382/173; 382/286; 382/291; 702/19; 702/22; 935/10; 935/24; 935/72; 536/22.1
(58) Field of Search .......................... 435/6, 91.1, 91.2; 536/24.3, 22.1, 23.1; 935/6; 436/518

(56) References Cited

PUBLICATIONS

Mickelson et al., "Differential Expression and Release of CD54 Induced by Cytokines", *Hepatol.*, 22: 866–875 (1995).

Nagendra et al., "CD18 integrin and CD54–dependent neutrophil adhesion to cytokine–stimulated human hepatocytes", *Am. J. Physiol.*, 272: G408–G416 (1997).

Hasmall, S.C. and R.A. Roberts, "The Perturbation of Apoptosis and Mitosis by Drugs and Xenobiotics", *Pharmacol. Ther.*, 82: 63–70 (1999).

Gelman, L. et al., "An update on the mechanisms of action of the peroxisome proliferator–activated receptors (PPARs) and their roles in inflammation and cancer", *Cell. Mol. Life Sci.*, 55: 932–943 (1999).

Kawashima, H. et al., "Protein Expression, Characterization, and Regulation of CYP4F4 and CYP4F5 Cloned from Rat Brain", *Arch. Biochem. Biophys.*, 347: 148–154 (1997).

Zhou, S. and K. B. Wallace, "The Effect of Peroxisome Proliferators on Mitochondrial Bioenergetics", *Toxicol. Sci.*, 48: 82–89 (1999).

*Primary Examiner*—Kenneth R. Horlick
(74) *Attorney, Agent, or Firm*—Incyte Corporation

(57) ABSTRACT

The present invention relates to a composition comprising a plurality of cDNAs which are differentially expressed in treated human C3A liver cell cultures and which may be used entirely or in part to diagnose, to stage, to treat, or to monitor the progression or treatment of liver disorders such as hyperlipidemia.

13 Claims, No Drawings

GENES EXPRESSED IN TREATED HUMAN C3A LIVER CELL CULTURES

This application claims the benefit of provisional application Ser. No. 60/222,113 filed Jul. 28, 2000.

FIELD OF THE INVENTION

The present invention relates to a composition comprising a plurality of cDNAs which are differentially expressed in treated human C3A liver cell cultures and which may be used entirely or in part to diagnose, to stage, to treat, or to monitor the progression or treatment of liver disorders such as hyperlipidemia.

BACKGROUND OF THE INVENTION

Array technology can provide a simple way to explore the expression of a single polymorphic gene or the expression profile of a large number of related or unrelated genes. When the expression of a single gene is examined, arrays are employed to detect the expression of a specific gene or its variants. When an expression profile is examined, arrays provide a platform for examining which genes are tissue specific, carrying out housekeeping functions, parts of a signaling cascade, or specifically related to a particular genetic predisposition, condition, disease, or disorder.

The potential application of gene expression profiling is particularly relevant to improving diagnosis, prognosis, and treatment of disease. For example, both the levels and sequences expressed in tissues from subjects with hyperlipidemia may be compared with the levels and sequences expressed in normal tissue.

Toxicity testing is a mandatory and time-consuming part of drug development programs in the pharmaceutical industry. A more rapid screen to determine the effects upon metabolism and to detect toxicity of lead drug candidates may be the use of gene expression microarrays. For example, microarrays of various kinds may be produced using full length genes or gene fragments. These arrays can then be used to test samples treated with the drug candidates to elucidate the gene expression pattern associated with drug treatment. This gene pattern can be compared with gene expression patterns associated with compounds which produce known metabolic and toxicological responses.

The human C3A cell line is a clonal derivative of HepG2/C3 (hepatoma cell line, isolated from a 15-year-old male with liver tumor), which was selected for strong contact inhibition of growth. The use of a clonal population enhances the reproducibility of the cells. C3A cells have many characteristics of primary human hepatocytes in culture: i) expression of insulin receptor and insulin-like growth factor II receptor; ii) secretion of a high ratio of serum albumin compared with α-fetoprotein iii) convertion of ammonia to urea and glutamine; iv) metabolize aromatic amino acids; and v) are able to proliferate in glucose-free and insulin-free medium. The C3A cell line is now well established as an in vitro model of the mature human liver (Mickelson et al. (1995) Hepatology 22:866–875; Nagendra et al. (1997) Am J Physiol 272:G408–416).

Clofibrate is an hypolidemic drug which lowers elevated levels of serum triglycerides. In rodents, chronic treatment produces hepatomegaly and an increase in hepatic peroxisomes (peroxisome proliferation). Peroxisome proliferators (PPs) are a class of drugs which activate the PP-activated receptor in rodent liver, leading to enzyme induction, stimulation of S-phase, and a suppression of apoptosis (Hasmall and Roberts (1999) Pharmacol. Ther. 82:63–70). PPs include the fibrate class of hypolidemic drugs, phenobarbitone, thiazolidinediones, certain non-steroidal anti-inflarnmatory drugs, and naturally-occuring fatty acid-derived molecules (Gelman et al. (1999) Cell. Mol. Life Sci. 55:932–943). Clofibrate has been shown to increase levels of cytochrome P450 4A. It is also involved in transcription of β-oxidation genes as well as induction of PP-activated receptors (Kawashima et al. (1997) Arch. Biochem. Biophys. 347:148–154). Peroxisome proliferation that is induced by both clofibrate and the chemically-related compound fenofibrate is mediated by a common inhibitory effect on mitochondrial membrane depolarization (Zhou and Wallace (1999) Toxicol. Sci. 48:82–89).

Captopril is an antihypertensive known as an angiotensin converting enzyme (ACE) inhibitor. ACE is a target for treatment of myocardial infarction and hypotension. ACE inhibitors can be classified into three broad groups based on chemical structure: i) sulfhydryl-containing ACE inhibitors, structurally related to captopril (e.g., fentiapril, pivalo-pril, zofenopril, alacepril); ii) dicarboxyl-containing ACE inhibitors, structurally related to enalapril (e.g., lisinopril, benazepril, quinapril, moexipril, ramipril, spirapril, perindopril, indolapril, pentopril, indala-pril, cilazapril); and iii) phosphorus-containing ACE inhibitors, structurally related to fosinopril. Many ACE inhibitors are ester-containing prodrugs that are 100 to 1000 times less potent as ACE inhibitors than their active metabolites, but have a much better oral bioavailability than the active molecules. Approximately 16 different ACE inhibitors are used worldwide. In general, ACE inhibitors differ with respect to potency; whether ACE inhibition is due to the drug itself or to activation of a prodrug; and pharmacokinetic properties. With the notable exceptions of fosinopril and spirapril (which display balanced elimination by the liver and kidneys), ACE inhibitors are cleared predominantly by the kidneys. Drugs that interfere with the renin-angiotensin system play a prominent role in the treatment cardiovascular disease and have been used as a therapy for a number of diseases including hypotension, left ventricular systolic dysfunction, myocardial infarction, progressive renal impairment, and scleroderma renal crisis.

Enalapril is a prodrug that is not highly active and, as such, it must be hydrolyzed by esterases in the liver to produce the active parent dicarboxylic acid, enalaprilat. Enalaprilat is a highly potent inhibitor of ACE with a Ki of 0.2 nM but differs from captopril in that it is an analog of a tripeptide rather than a dipeptide. Enalapril is rapidly absorbed when given orally and has an oral bioavailability of about 60% (not reduced by food). Although peak concentrations of plasma enalapril occur within an hour, enalaprilat concentrations do not peak until three to four hours. Enalapril has a half-life of only 1.3 hours. However, because it binds tightly to ACE, enalaprilat has a plasma half-life of about 11 hours. Nearly all the drug is eliminated by the kidneys either as intact enalapril or enalaprilat.

Dexamethasone and its derivatives, dexamethasone sodium phosphate and dexamethasone acetate, are synthetic glucocorticoids used as anti-inflammatory or immunosuppressive agents. Dexamethasone has little to no mineralocorticoid activity and is usually selected for management of cerebral edema because of its superior ability to penetrate the central nervous sytem. Glucocorticoids are naturally occurring hormones that prevent or suppress inflammation and immune responses when administered at pharmacological doses. Responses can include inhibition of leukocyte infiltration at the site of inflammation, interference in the function of mediators of inflammatory response, and suppression of humoral immune responses. The anti-inflammatory actions of corticosteroids are thought to involve phospholipase $A_2$ inhibitory proteins, collectively called lipocortins. The numerous adverse effects related to corticosteroid use usually depend on the dose administered and the duration of therapy. Proposed mechanisms of action include decreased IgE synthesis, increased number of β-adrenergic receptors on leukocytes, and decreased arachidonic acid metabolism. During an immediate allergic reaction, such as in chronic bronchial asthma, allergens bridge the IgE antibodies on the surface of mast cells, which triggers these cells to release chemotactic substances. Mast cell influx and activation, therefore, is partially responsible for the inflammation and hyperirritability of the oral mucosa in asthmatic patients. This inflammation can be retarded by administration of adrenocorticoids. As with other corticosteroids, the effects upon liver metabolism and hormone clearance mechanisms are important to understand the pharmacodynamics of a drug.

Diethylstilbestrol (DES) is used for the palliative treatment of advanced, inoperable, metastatic carcinoma of the breast in post-menopausal women and in men. Estrogens are not used in the treatment of breast cancer in premenopausal women, because the drugs may stimulate tumor growth rather than inhibit it. In males, DES is used for the palliative treatment of advanced carcinoma of the prostate; however, the risk of adverse cardiovascular effects of estrogens are also considered. The specific role of estrogen therapy compared with other therapies (e.g., orchiectomy, treatment with analogs of gonadotropin releasing hormone) in the treatment of prostatic cancer has not been clearly determined. Hormonal manipulation with estrogens currently is considered a therapy of choice for patients with inoperable prostatic tumors, patients who refuse orchiectomy, and patients whose disease progresses despite orchiectomy in whom the benefits of estrogen use are considered to outweigh the risk of adverse effects. As with other steroid hormones, the effects upon liver metabolism and hormone clearance mechanisms are important to understand the pharmacodynamics of a drug.

The polycyclic aromatic hydrocarbon 3-methylcholanthrene (MCA) is a potent carcinogen that is often used in experimental cancer studies. MCA is also a strong inducer of the cytochrome P450 genes in humans. In animal models, MCA induces the upregulation of the cytochrome P450 CYP1A isoforms in the liver of treated rats.

Insulin resistance is central to the pathophysiology of type II diabetes and a number of other disease states. It has been known for some time that down-regulation and reduced tyrosine kinase activity of the insulin receptor play a role in insulin resistance. However, defects in the intracellular responses to insulin are also very important, in particular, tyrosine phosphorylation of the insulin receptor substrate 1 (IRS-1) and IRS-1/phosphatidyinositol-3 (PI3) kinase interaction. Despite many advances in the field, understanding of how insulin stimulates glucose transport is fragmentary, in part because the major targets for insulin signaling to glucose transport is a complex membrane trafficking pathway that is likely to contain many unknown components. Understanding the fundamental physiological response of insulin will help to unravel the causes of insulin resistance in type II diabetes. LY294002 is a PI3 kinase-specific inhibitor that promotes cell cycle arrest of C3A cells and promotes differentiation. This inhibitor also appears to affect the metabolic activity of the cells, especially with respect to proteins such as cytochrome P450 molecules.

The present invention provides for a composition comprising a plurality of cDNAs for use in detecting changes in expression of genes encoding proteins that are associated with treated human C3A liver cell cultures. Such a composition can be employed for the diagnosis, prognosis or treatment of hyperlipidemia and other disorders, such as hypertension, type II diabetes, and tumors of the liver, correlated with differential gene expression. The present invention satisfies a need in the art in that it provides a set of differentially expressed genes which may be used entirely or in part to diagnose, to stage, to treat, or to monitor the progression or treatment of a subject with a disorder such as hyperlipidemia.

SUMMARY

The present invention provides a composition comprising a plurality of cDNAs and their complements which are differentially expressed in treated human C3A liver cell cultures and which are selected from SEQ ID NOs:1–401 as presented in the Sequence Listing. In one embodiment, each cDNA is downregulated at least two-fold, SEQ ID NOs:3, 32, 94, 99, 100, 108, 137, 196, 274, 299, 380; in another embodiment, each cDNA is upregulated at least two-fold, SEQ ID NOs:9, 10, 70, 144, 145, 147, 164, 186, 190, 191, 203, 271, 305, 344. In one aspect, the composition is useful to diagnose a liver disorder selected from hyperlipidemia, hypertension, type II diabetes, and tumors of the liver. In another aspect, the composition is immobilized on a substrate.

The invention also provides a high throughput method to detect differential expression of one or more of the cDNAs of the composition. The method comprises hybridizing the substrate comprising the composition with the nucleic acids of a sample, thereby forming one or more hybridization complexes, detecting the hybridization complexes, and comparing the hybridization complexes with those of a standard, wherein differences in the size and signal intensity of each hybridization complex indicates differential expression of nucleic acids in the sample. In one aspect, the sample is from a subject with hyperlipidemia and differential expression determines an early, mid, and late stage of that disorder.

The invention further provides a high throughput method of screening a library or a plurality of molecules or compounds to identify a ligand. The method comprises combining the substrate comprising the composition with a library or a plurality of molecules or compounds under conditions to allow specific binding and detecting specific binding, thereby identifying a ligand. The library or a plurality of molecules or compounds are selected from DNA molecules, RNA molecules, peptide nucleic acid molecules, mimetics, peptides, transcription factors, repressors, and other regulatory proteins.

The invention still further provides an isolated cDNA selected from SEQ ID NOs:23, 56, 59, 97, 136, 155, 157, 226, 255, 264, 303, 308, 310, 330, 353, 354, 364, 395 as presented in the Sequence Listing. The invention also provides a vector comprising the cDNA, a host cell comprising the vector, and a method for producing a protein comprising culturing the host cell under conditions for the expression of a protein and recovering the protein from the host cell culture. The invention additionally provides a method for purifying a ligand, the method comprising combining a cDNA of the invention with a sample under conditions which allow specific binding, recovering the bound cDNA, and separating the cDNA from the ligand, thereby obtaining purified ligand.

The present invention provides a purified protein encoded and produced by a cDNA of the invention. The invention also provides a high-throughput method for using a protein to screen a library or a plurality of molecules or compounds to identify a ligand. The method comprises combining the protein or a portion thereof with the library or a plurality of molecules or compounds under conditions to allow specific binding and detecting specific binding, thereby identifying a ligand which specifically binds the protein. A library or a plurality of molecules or compounds are selected from DNA molecules, RNA molecules, peptide nucleic acid molecules, mimetics, peptides, proteins, agonists, antagonists, antibodies or their fragments, immunoglobulins, inhibitors, drug compounds, and pharmaceutical agents. The invention further provides for using a protein to purify a ligand. The method comprises combining the protein or a portion thereof with a sample under conditions to allow specific binding, recovering the bound protein, and separating the protein from the ligand, thereby obtaining purified ligand. The invention still further provides a pharmaceutical composition comprising the protein. The invention yet still further provides a method for using the protein to produce an antibody. The method comprises immunizing an animal with the protein or an antigenically-effective epitope under conditions to elicit an antibody response, isolating animal antibodies, and screening the isolated antibodies with the protein to identify an antibody which specifically binds the protein. The invention yet still further provides a method for using the protein to purify antibodies which bind specifically to the protein.

The invention also provides a purified protein selected from SEQ ID NOs: 158, 311, 331.

DESCRIPTION OF THE SEQUENCE LISTING AND TABLES

A portion of the disclosure of this patent document contains material that is subject to copyright protection. The copyright owner has no objection to the facsimile reproduction by anyone of the patent document or the patent disclosure, as it appears in the Patent and Trademark Office patent file or records, but otherwise reserves all copyright rights whatsoever.

The Sequence Listing is a compilation of cDNAs obtained by sequencing and extension of clone inserts. Each sequence is identified by a sequence identification number (SEQ ID NO) and by the template number (TEMPLATE ID) from which it was obtained.

Table 1 lists the differential expression levels of cDNA as a function of the increase or decreased levels compared with levels in untreated human C3A liver cell cultures. Column 1 lists the clone present on the array (CLONE ID). Columns 2 through 10 list the compound used to treat the cell cultures, Clofibrate, Fenofibrate, Captopril, Enalapril, Dexamethasone, diethylstilbestrol (DES) 3-methylcholanthrene (MCA), LY294002, or insulin together with LY294002 (INS/LY294002), respectively.

Table 2 shows the nucleotide template sequence corresponding to the encoded protein template and to the clone present on the microarray. Columns 1, 2, 3, 4, and 5 show the clone number (CLONE ID), nucleotide SEQ ID NO, nucleotide TEMPLATE ID, protein SEQ ID NO, and protein TEMPLATE ID, respectively. Template IDs with the suffix 'c' read on the complementary nucleotide strand.

Table 3 lists the functional annotation of the cDNAs of the present invention. Columns 1 and 2 show the SEQ ID NO and TEMPLATE ID, respectively. Columns 3, 4, and 5 show the GenBank hit (GI Number), probability score (E-value), and functional annotation, respectively, as determined by BLAST analysis (version 1.4 using default parameters; Altschul (1993) J Mol Evol 36: 290–300; Altschul et al. (1990) J Mol Biol 215:403410) of the cDNA against GenBank (release 116; National Center for Biotechnology Information (NCBI), Bethesda Md).

Table 4 shows Pfam annotations of the cDNAs of the present invention. Columns 1 and 2 show the SEQ ID NO and TEMPLATE ID, respectively. Columns 3, 4, and 5 show the first residue (START), last residue (STOP), and reading frame (FRAME), respectively, for the segment of the cDNA identified by Pfam analysis. Columns 6, 7, and 8 show the Pfam ID, Pfam description, and E-values, respectively, corresponding to the polypeptide domain encoded by the cDNA segment.

Table 5 shows signal peptide and transmembrane regions predicted within the cDNAs of the present invention. Columns 1 and 2 show the SEQ ID NO and TEMPLATE ID, respectively. Columns 3, 4, and 5 show the first residue (START), last residue (STOP), and reading frame (FRAME), respectively, for a segment of the cDNA, and column 6 (HIT TYPE) identifies the polypeptide encoded by the segment as either a signal peptide (SP) or transmembrane (TM) domain.

Table 6 shows the region of each cDNA encompassed by the clone present on a microarray and identified as differentially expressed. Columns 1 and 2 show the SEQ ID NO and TEMPLATE ID, respectively. Column 3 shows the CLONE ID and columns 4 and 5 show the first residue (START) and last residue (STOP) encompassed by the clone on the template.

Table 7 lists the tissue distribution of the nucleotide templates. Columns 1 and 2 list the SEQ ID NO and TEMPLATE ID, respectively. Column 3 lists the predominant tissue distribution (TISSUE DISTRIBUTION) as a percentage of total tissues in the Incyte LIFESEQ GOLD database (Incyte Genomics, Palo Alto Calif.).

DESCRIPTION OF THE INVENTION
Definitions

"Array" refers to an ordered arrangement of at least two cDNAs on a substrate. At least one of the cDNAs represents a control or standard sequence, and the other, a cDNA of diagnostic interest. The arrangement of from about two to about 40,000 cDNAs on the substrate assures that the size and signal intensity of each labeled hybridization complex formed between a cDNA and a sample nucleic acid is individually distinguishable.

The "complement" of a nucleic acid molecule of the Sequence Listing refers to a cDNA which is completely complementary over the full length of the sequence and which will hybridize to the nucleic acid molecule under conditions of high stringency.

A "composition" comprises at least two and up to 401 sequences of the Sequence Listing. "cDNA" refers to a chain of nucleotides, an isolated polynucleotide, nucleic acid molecule, or any fragment or complement thereof. It may have originated recombinantly or synthetically, be double-stranded or single-stranded, coding and/or noncoding, an exon with or without an intron from a genomic DNA molecule, and purified or combined with carbohydrate, lipids, protein or inorganic elements or substances. Preferably, the cDNA is from about 4000 to about 5000 nucleotides.

The phrase "cDNA encoding a protein" refers to a nucleic acid sequence that closely aligns with sequences which encode conserved regions, motifs or domains that were identified by employing analyses well known in the art.

These analyses include BLAST (Basic Local Alignment Search Tool; Altschul (1993) J Mol Evol 36: 290–300; Altschul et al. (1990) J Mol Biol 215:403–410) which provides identity within the conserved region. Brenner et al. (1998; Proc Natl Acad Sci 95:6073–6078) who analyzed BLAST for its ability to identify structural homologs by sequence identity found 30% identity is a reliable threshold for sequence alignments of at least 150 residues and 40% is a reasonable threshold for alignments of at least 70 residues (Brenner et al., page 6076, column 2).

"Derivative" refers to a cDNA or a protein that has been subjected to a chemical modification. Derivatization of a cDNA can involve substitution of a nontraditional base such as queosine or of an analog such as hypoxanthine. These substitutions are well known in the art. Derivatization of a protein involves the replacement of a hydrogen by an acetyl, acyl, alkyl, amino, formyl, or morpholino group. Derivative molecules retain the biological activities of the naturally occurring molecules but may confer advantages such as longer lifespan or enhanced activity.

"Differential expression" refers to an increased, upregulated or present, or decreased, downregulated or absent, gene expression as detected by the absence, presence, or at least two-fold changes in the amount of transcribed messenger RNA or translated protein in a sample.

"Disorder" refers to conditions, diseases or syndromes of the liver, including hyperlipidemia, hypertension, type II diabetes, tumors of the liver, and disorders of the inflammatory and immune response.

"Fragment" refers to a chain of consecutive nucleotides from about 200 to about 700 base pairs in length. Fragments may be used in PCR or hybridization technologies to identify related nucleic acid molecules and in binding assays to screen for a ligand. Nucleic acids and their ligands identified in this manner are useful as therapeutics to regulate replication, transcription or translation.

A "hybridization complex" is formed between a cDNA and a nucleic acid of a sample when the purines of one molecule hydrogen bond with the pyrimidines of the complementary molecule, e.g., 5'-A-G-T-C-3' base pairs with 3'-T-C-A-G-5'. The degree of complementarity and the use of nucleotide analogs affect the efficiency and stringency of hybridization reactions.

"Ligand" refers to any agent, molecule, or compound which will bind specifically to a complementary site on a cDNA molecule or polynucleotide, or to an epitope or a protein. Such ligands stabilize or modulate the activity of polynucleotides or proteins and may be composed of inorganic or organic substances including nucleic acids, proteins, carbohydrates, fats, and lipids.

"Oligonucleotide" refers a single stranded molecule from about 18 to about 60 nucleotides in length which may be used in hybridization or amplification technologies or in regulation of replication, transcription or translation. Substantially equivalent terms are amplimer, primer, and oligomer.

"Portion" refers to any part of a protein used for any purpose; but especially, to an epitope for the screening of ligands or for the production of antibodies.

"Post-translational modification" of a protein can involve lipidation, glycosylation, phosphorylation, acetylation, racemization, proteolytic cleavage, and the like. These processes may occur synthetically or biochemically. Biochemical modifications will vary by cellular location, cell type, pH, enzymatic milieu, and the like.

"Probe" refers to a cDNA that hybridizes to at least one nucleic acid molecule in a sample. Where targets are single stranded, probes are complementary single strands. Probes can be labeled with reporter molecules for use in hybridization reactions including Southern, northern, in situ, dot blot, array, and like technologies or in screening assays.

"Protein" refers to a polypeptide or any portion thereof. A "portion" of a protein retains at least one biological or antigenic characteristic of a native protein. An "oligopeptide" is an amino acid sequence from about five residues to about 15 residues that is used as part of a fusion protein to produce an antibody.

"Purified" refers to any molecule or compound that is separated from its natural environment and is from about 60% free to about 90% free from other components with which it is naturally associated.

"Sample" is used in its broadest sense as containing nucleic acids, proteins, antibodies, and the like. A sample may comprise a bodily fluid; the soluble fraction of a cell preparation, or an aliquot of media in which cells were grown; a chromosome, an organelle, or membrane isolated or extracted from a cell; genomic DNA, RNA, or cDNA in solution or bound to a substrate; a cell; a tissue; a tissue print; a fingerprint, buccal cells, skin, or hair; and the like.

"Specific binding" refers to a special and precise interaction between two molecules which is dependent upon their structure, particularly their molecular side groups. For example, the intercalation of a regulatory protein into the major groove of a DNA molecule, the hydrogen bonding along the backbone between two single stranded nucleic acids, or the binding between an epitope of a protein and an agonist, antagonist, or antibody.

"Similarity" as applied to sequences, refers to the quantification (usually percentage) of nucleotide or residue matches between at least two sequences aligned using a standardized algorithm such as Smith-Waterman alignment (Smith and Waterman (1981) J Mol Biol 147:195–197) or BLAST2 (Altschul et al. (1997) Nucleic Acids Res 25:3389–3402). BLAST2 may be used in a standardized and reproducible way to insert gaps in one of the sequences in order to optimize alignment and to achieve a more meaningful comparison between them.

"Substrate" refers to any rigid or semi-rigid support to which cDNAs or proteins are bound and includes membranes, filters, chips, slides, wafers, fibers, magnetic or nonmagnetic beads, gels, capillaries or other tubing, plates, polymers, and microparticles with a variety of surface forms including wells, trenches, pins, channels and pores.

"Variant" refers to molecules that are recognized variations of a cDNA or a protein encoded by the cDNA. Splice variants may be determined by BLAST score, wherein the score is at least 100, and most preferably at least 400. Allelic variants have a high percent identity to the cDNAs and may differ by about three bases per hundred bases. "Single nucleotide polymorphism" (SNP) refers to a change in a single base as a result of a substitution, insertion or deletion. The change may be conservative (purine for purine) or non-conservative (purine to pyrimidine) and may or may not result in a change in an encoded amino acid.

The Invention

The present invention provides for a composition comprising a plurality of cDNAs or their complements, SEQ ID NOs:1–401 which may be used on a substrate to diagnose, to stage, to treat or to monitor the progression or treatment of a liver disorder. These cDNAs represent known and novel genes differentially expressed in C3A liver cells treated with clofibrate, fenofibrate, captopril, enalapril, dexamethasone, diethylstilbestrol (DES) 3-methylcholanthrene (MCA), LY294002, or insulin together with LY294002. The composition may be used in its entirety or in part, as subsets of cDNAs downregulated by fibrates, SEQ ID NOs:3, 32, 94, 137, 196, 274, and 380; of cDNAs upregulated by fibrates SEQ ID NOs:9, 10, 70, 147, 164, 186, 190, 191, 203, 271, and 344; of cDNAs downregulated by captopril, enalapril, and dexamethasone SEQ ID NOs:3, 99, 100, 108, and 299; and of cDNAs upregulated by captopril, enalapril, and dexamethasone SEQ ID NOs:9, 10, 70, 144, 145, 190, 203, 271, and 305. SEQ ID NOs:23, 56, 59, 97, 136, 155, 157, 226, 255, 264, 303, 308, 310, 330, 353, 354, 364, and 395 represent novel cDNAs associated with treatment of human C3A liver cells. Since the novel cDNAs were identified solely by their differential expression, it is not essential to know a priori the name, structure, or function of the gene or the protein encoded thereby. The usefulness of the novel cDNAs exists in their immediate value as diagnostics for disorders of liver metabolism and tumors of the liver.

The invention also provides isolated proteins SEQ ID NOs:158, 311, 331 which are encoded by the cDNAs of SEQ ID NOs:157, 310, 330 as shown in Table 2.

Table 1 shows those genes on the array having differential expression (two-fold or greater increase or decrease) in treated human C3A liver cell cultures. Column 1 shows the clone ID and columns 2 through 10 show the measured expression levels of the cDNA in C3A cells treated with clofibrate, fenofibrate, captopril, enalapril, dexamethasone, diethylstilbestrol (DES) 3-methyl-cholanthrene (MCA), LY294002, and insulin together with LY294002, respectively. Table 2 shows the nucleotide template sequences and the respective encoded proteins sequences which correspond to the upregulated or downregulated clones present on the array. Table 3 shows the functional annotation of the template cDNAs as determined by BLAST analysis. Table 4 shows the functional annotation as determined by Pfam analysis. Table 5 shows the functional annotation as determined by Hidden Markov Model analysis for signal peptide or for transmembrane regions, column 6:SP or TM, respectively. Table 6 shows the positional information of the clone present on the array relative to the nucleotide template sequence. Table 7 shows the tissue distribution of the nucleotide template sequences.

The cDNAs of the invention define a differential expression pattern against which to compare the expression pattern of biopsied and/or in vitro treated human liver tissues. Experimentally, differential expression of the cDNAs can be evaluated by methods including, but not limited to, differential display by spatial immobilization or by gel electrophoresis, genome mismatch scanning, representational discriminant analysis, clustering, transcript imaging and array technologies. These methods may be used alone or in combination.

The composition may be arranged on a substrate and hybridized with tissues from subjects with diagnosed liver disorders to identify those sequences which are differentially expressed in both hyperlipidemia and other liver disorders. This allows identification of those sequences of highest diagnostic and potential therapeutic value. In one embodiment, an additional set of cDNAs, such as cDNAs encoding signaling molecules, are arranged on the substrate with the composition. Such combinations may be useful in the elucidation of pathways which are affected in a particular liver disorder or to identify new, coexpressed, candidate, therapeutic molecules.

In another embodiment, the composition can be used for large scale genetic or gene expression analysis of a large number of novel, nucleic acid molecules. These samples are prepared by methods well known in the art and are from mammalian cells or tissues which are in a certain stage of development; have been treated with a known molecule or compound, such as a cytokine, growth factor, a drug, and the like; or have been extracted or biopsied from a mammal with a known or unknown condition, disorder, or disease before or after treatment. The sample nucleic acid molecules are hybridized to the composition for the purpose of defining a novel gene profile associated with that developmental stage, treatment, or disorder.

cDNAs and Their Uses cDNAs can be prepared by a variety of synthetic or enzymatic methods well known in the art. cDNAs can be synthesized, in whole or in part, using chemical methods well known in the art (Caruthers et al. (1980) Nucleic Acids Symp. Ser. (7)215–233). Alternatively, cDNAs can be produced enzymatically or recombinantly, by in vitro or in vivo transcription.

Nucleotide analogs can be incorporated into cDNAs by methods well known in the art. The only requirement is that the incorporated analog must base pair with native purines or pyrimidines. For example, 2,6-diaminopurine can substitute for adenine and form stronger bonds with thymidine than those between adenine and thymidine. A weaker pair is formed when hypoxanthine is substituted for guanine and base pairs with cytosine. Additionally, cDNAs can include nucleotides that have been derivatized chemically or enzymatically.

cDNAs can be synthesized on a substrate. Synthesis on the surface of a substrate may be accomplished using a chemical coupling procedure and a piezoelectric printing apparatus as described by Baldeschweiler et al. (PCT publication WO95/251116). Alternatively, the cDNAs can be synthesized on a substrate surface using a self-addressable electronic device that controls when reagents are added as described by Heller et al. (U.S. Pat. No. 5,605,662). cDNAs can be synthesized directly on a substrate by sequentially dispensing reagents for their synthesis on the substrate surface or by dispensing preformed DNA fragments to the substrate surface. Typical dispensers include a micropipette delivering solution to the substrate with a robotic system to control the position of the micropipette with respect to the substrate. There can be a multiplicity of dispensers so that reagents can be delivered to the reaction regions efficiently.

cDNAs can be immobilized on a substrate by covalent means such as by chemical bonding procedures or UV irradiation. In one method, a cDNA is bound to a glass surface which has been modified to contain epoxide or aldehyde groups. In another method, a cDNA is placed on a polylysine coated surface and UV cross-linked to it as described by Shalon et al. (WO95/35505). In yet another method, a cDNA is actively transported from a solution to a given position on a substrate by electrical means (Heller, supra). cDNAs do not have to be directly bound to the substrate, but rather can be bound to the substrate through a linker group. The linker groups are typically about 6 to 50 atoms long to provide exposure of the attached cDNA. Preferred linker groups include ethylene glycol oligomers, diamines, diacids and the like. Reactive groups on the substrate surface react with a terminal group of the linker to bind the linker to the substrate. The other terminus of the linker is then bound to the cDNA. Alternatively, polynucleotides, plasmids or cells can be arranged on a filter. In the latter case, cells are lysed, proteins and cellular components degraded, and the DNA is coupled to the filter by UV cross-linking.

The cDNAs may be used for a variety of purposes. For example, the composition of the invention may be used on an array. The array, in turn, can be used in high-throughput methods for detecting a related polynucleotide in a sample, screening a plurality of molecules or compounds to identify a ligand, diagnosing a liver disorder, or inhibiting or inactivating a therapeutically relevant gene related to the cDNA.

When the cDNAs of the invention are employed on a microarray, the cDNAs are arranged in an ordered fashion so that each cDNA is present at a specified location. Because the cDNAs are at specified locations on the substrate, the hybridization patterns and intensities, which together create a unique expression profile, can be interpreted in terms of expression levels of particular genes and can be correlated with a particular metabolic process, condition, disorder, disease, stage of disease, or treatment.

Hybridization

The cDNAs or fragments or complements thereof may be used in various hybridization technologies. The cDNAs may be labeled using a variety of reporter molecules by either PCR, recombinant, or enzymatic techniques. For example, a commercially available vector containing the cDNA is transcribed in the presence of an appropriate polymerase, such as T7 or SP6 polymerase, and at least one labeled nucleotide. Commercial kits are available for labeling and cleanup of such cDNAs. Radioactive (Amersham Pharmacia Biotech (APB), Piscataway N.J.), fluorescent (Operon Technologies, Alameda Calif.), and chemiluminescent labeling (Promega, Madison Wis.) are well known in the art.

A cDNA may represent the complete coding region of an MRNA or be designed or derived from unique regions of the mRNA or genomic molecule, an intron, a 3' untranslated region, or from a conserved motif. The cDNA is at least 18 contiguous nucleotides in length and is usually single stranded. Such a cDNA may be used under hybridization conditions that allow binding only to an identical sequence, a naturally occurring molecule encoding the same protein, or an allelic variant. Discovery of related human and mammalian sequences may also be accomplished using a pool of degenerate cDNAs and appropriate hybridization conditions. Generally, a cDNA for use in Southern or northern hybridizations may be from about 400 to about 6000 nucleotides long. Such cDNAs have high binding specificity in solution-based or substrate-based hybridizations. An oligonucleotide, a fragment of the cDNA, may be used to detect a polynucleotide in a sample using PCR.

The stringency of hybridization is determined by G+C content of the cDNA, salt concentration, and temperature. In particular, stringency is increased by reducing the concentration of salt or raising the hybridization temperature. In solutions used for some membrane based hybridizations, addition of an organic solvent such as formamide allows the reaction to occur at a lower temperature. Hybridization may be performed with buffers, such as 5×saline sodium citrate (SSC) with 1% sodium dodecyl sulfate (SDS) at 60° C., that permit the formation of a hybridization complex between nucleic acid sequences that contain some mismatches. Subsequent washes are performed with buffers such as 0.2×SSC with 0.1% SDS at either 45° C. (medium stringency) or 65°68° C. (high stringency). At high stringency, hybridization complexes will remain stable only where the nucleic acid molecules are completely complementary. In some membrane-based hybridizations, preferably 35% or most preferably 50%, formamide may be added to the hybridization solution to reduce the temperature at which hybridization is performed. Background signals may be reduced by the use of detergents such as Sarkosyl or Triton X-100 (Sigma Aldrich, St. Louis Mo.) and a blocking agent such as denatured salmon sperm DNA. Selection of components and conditions for hybridization are well known to those skilled in the art and are reviewed in Ausubel et al. (1997, *Short Protocols in Molecular Biology*, John Wiley & Sons, New York N.Y., Units 2.8–2.11, 3.18–3.19 and 4–64.9).

Dot-blot, slot-blot, low density and high density arrays are prepared and analyzed using methods known in the art. cDNAs from about 18 consecutive nucleotides to about 5000 consecutive nucleotides in length are contemplated by the invention and used in array technologies. The preferred number of cDNAs on an array is at least about 100,000, a more preferred number is at least about 40,000, an even more preferred number is at least about 10,000, and a most preferred number is at least about 600 to about 800. The array may be used to monitor the expression level of large numbers of genes simultaneously and to identify genetic variants, mutations, and SNPs. Such information may be used to determine gene function; to understand the genetic basis of a disorder; to diagnose a disorder; and to develop and monitor the activities of therapeutic agents being used to control or cure a disorder. (See, e.g., U.S. Pat. No. 5,474, 796; WO95/11995; WO95/35505; U.S. Pat. No. 5,605,662; and U.S. Pat. No. 5,958,342.)

Screening and Purification Assays

A cDNA may be used to screen a library or a plurality of molecules or compounds for a ligand which specifically binds the cDNA. Ligands may be DNA molecules, RNA molecules, peptide nucleic acid molecules, peptides, proteins such as transcription factors, promoters, enhancers, repressors, and other proteins that regulate replication, transcription, or translation of the polynucleotide in the biological system. The assay involves combining the cDNA or a fragment thereof with the molecules or compounds under conditions that allow specific binding and detecting the bound cDNA to identify at least one ligand that specifically binds the cDNA.

In one embodiment, the cDNA may be incubated with a library of isolated and purified molecules or compounds and binding activity determined by methods such as a gel-retardation assay (U.S. Pat. No. 6,010,849) or a reticulocyte lysate transcriptional assay. In another embodiment, the cDNA may be incubated with nuclear extracts from biopsied and/or cultured cells and tissues. Specific binding between the cDNA and a molecule or compound in the nuclear extract is initially determined by gel shift assay. Protein binding may be confirmed by raising antibodies against the protein and adding the antibodies to the gel-retardation assay where specific binding will cause a supershift in the assay.

In another embodiment, the cDNA may be used to purify a molecule or compound using affinity chromatography methods well known in the art. In one embodiment, the cDNA is chemically reacted with cyanogen bromide groups on a polymeric resin or gel. Then a sample is passed over and reacts with or binds to the cDNA. The molecule or compound which is bound to the cDNA may be released from the cDNA by increasing the salt concentration of the flow-through medium and collected.

The cDNA may be used to purify a ligand from a sample. A method for using a cDNA to purify a ligand would involve combining the cDNA or a fragment thereof with a sample under conditions to allow specific binding, recovering the bound cDNA, and using an appropriate agent to separate the cDNA from the purified ligand.

Protein Production and Uses

The full length cDNAs or fragment thereof may be used to produce purified proteins using recombinant DNA technologies described herein and taught in Ausubel et al. (supra; Units 16.1–16.62). One of the advantages of producing proteins by these procedures is the ability to obtain highly-enriched sources of the proteins thereby simplifying purification procedures.

The proteins may contain amino acid substitutions, deletions or insertions made on the basis of similarity in polarity, charge, solubility, hydrophobicity, hydrophilicity, and/or the amphipathic nature of the residues involved. Such substitutions may be conservative in nature when the substituted residue has structural or chemical properties similar to the original residue (e.g., replacement of leucine with isoleucine or valine) or they may be nonconservative when the replacement residue is radically different (e.g., a glycine replaced by a tryptophan). Computer programs included in LASER-GENE software (DNASTAR, Madison Wis.), MACVECTOR software (Genetics Computer Group, Madison Wis.) and RasMol software (www.umass.edu/microbio/rasmol) may be used to help determine which and how many amino acid residues in a particular portion of the protein may be substituted, inserted, or deleted without abolishing biological or immunological activity.

Expression of Encoded Proteins

Expression of a particular cDNA may be accomplished by cloning the cDNA into a vector and transforming this vector into a host cell. The cloning vector used for the construction of cDNA libraries in the LIFESEQ databases may also be used for expression. Such vectors usually contain a promoter and a polylinker useful for cloning, priming, and transcription. An exemplary vector may also contain the promoter for β-galactosidase, an amino-terminal methionine and the subsequent seven amino acid residues of β-galactosidase. The vector may be transformed into competent E. coli cells. Induction of the isolated bacterial strain with isopropylthiogalactoside (IPTG) using standard methods will produce a fusion protein that contains an N terminal methionine, the first seven residues of β-galactosidase, about 15 residues of linker, and the protein encoded by the cDNA.

The cDNA may be shuttled into other vectors known to be useful for expression of protein in specific hosts. Oligonucleotides containing cloning sites and fragments of DNA sufficient to hybridize to stretches at both ends of the cDNA may be chemically synthesized by standard methods. These primers may then be used to amplify the desired fragments by PCR. The fragments may be digested with appropriate restriction enzymes under standard conditions and isolated using gel electrophoresis. Alternatively, similar fragments are produced by digestion of the cDNA with appropriate restriction enzymes and filled in with chemically synthesized oligonucleotides. Fragments of the coding sequence from more than one gene may be ligated together and expressed.

Signal sequences that dictate secretion of soluble proteins are particularly desirable as component parts of a recombinant sequence. For example, a chimeric protein may be expressed that includes one or more additional purification-facilitating domains. Such domains include, but are not limited to, metal-chelating domains that allow purification on immobilized metals, protein A domains that allow purification on immobilized immunoglobulin, and the domain utilized in the FLAGS extension/affinity purification system (Immunex, Seattle Wash.). The inclusion of a cleavable-linker sequence such as ENTEROKINASEMAX (Invitrogen, San Diego Calif.) between the protein and the purification domain may also be used to recover the protein.

Suitable host cells may include, but are not limited to, mammalian cells such as Chinese Hamster Ovary (CHO) and human 293 cells, insect cells such as Sf9 cells, plant cells such as Nicotiana tabacum, yeast cells such as Sac-charomyces cerevisiae, and bacteria such as E. coli. For each of these cell systems, a useful vector may also include an origin of replication and one or two selectable markers to allow selection in bacteria as well as in a transformed eukaryotic host. Vectors for use in eukaryotic host cells may require the addition of 3' poly(A) tail if the cDNA lacks poly(A).

Additionally, the vector may contain promoters or enhancers that increase gene expression. Many promoters are known and used in the art. Most promoters are host specific and exemplary promoters includes SV40 promoters for CHO cells; T7 promoters for bacterial hosts; viral promoters and enhancers for plant cells; and PGH promoters for yeast. Adenoviral vectors with the rous sarcoma virus enhancer or retroviral vectors with long terminal repeat promoters may be used to drive protein expression in mammalian cell lines. Once homogeneous cultures of recombinant cells are obtained, large quantities of secreted soluble protein may be recovered from the conditioned medium and analyzed using chromatographic methods well known in the art. An alternative method for the production of large amounts of secreted protein involves the transformation of mammalian embryos and the recovery of the recombinant protein from milk produced by transgenic cows, goats, sheep, and the like.

In addition to recombinant production, proteins or portions thereof may be produced manually, using solid-phase techniques (Stewart et al. (1969) Solid-Phase Peptide Synthesis, WH Freeman, San Francisco Calif.; Merrifield (1963) J Am Chem Soc 5:2149–2154), or using machines such as the ABI431A peptide synthesizer (Applied Biosystems, Foster City Calif.). Proteins produced by any of the above methods may be used as pharmaceutical compositions to treat disorders associated with null or inadequate expression of the genomic sequence.

Screening and Purification Assays

A protein or a portion thereof encoded by the cDNA may be used to screen a library or a plurality of molecules or compounds for a ligand with specific binding affinity or to purify a molecule or compound from a sample. The protein or portion thereof employed in such screening may be free in solution, affixed to an abiotic or biotic substrate, or located intracellularly. For example, viable or fixed prokaryotic host cells that are stably transformed with recombinant nucleic acids that have expressed and positioned a protein on their cell surface can be used in screening assays. The cells are screened against a library or a plurality of ligands and the specificity of binding or formation of complexes between the expressed protein and the ligand may be measured. The ligands may be DNA, RNA, or PNA molecules, agonists, antagonists, antibodies, immunoglobulins, inhibitors, peptides, pharmaceutical agents, proteins, drugs, or any other test molecule or compound that specifically binds the protein. An exemplary assay involves combining the mammalian protein or a portion thereof with the molecules or compounds under conditions that allow specific binding and detecting the bound protein to identify at least one ligand that specifically binds the protein.

This invention also contemplates the use of competitive drug screening assays in which neutralizing antibodies capable of binding the protein specifically compete with a test compound capable of binding to the protein or oligopeptide or fragment thereof. One method for high throughput screening using very small assay volumes and very small amounts of test compound is described in U.S. Pat. No. 5,876,946.

Molecules or compounds identified by screening may be used in a model system to evaluate their toxicity, diagnostic, or therapeutic potential.

The protein may be used to purify a ligand from a sample. A method for using a protein to purify a ligand would involve combining the protein or a portion thereof with a sample under conditions to allow specific binding, recovering the bound protein, and using an appropriate chaotropic agent to separate the protein from the purified ligand.

Production of Antibodies

A protein encoded by a cDNA of the invention may be used to produce specific antibodies. Antibodies may be produced using an oligopeptide or a portion of the protein with inherent immunological activity. Methods for producing antibodies include: 1) injecting an animal, usually goats, rabbits, or mice, with the protein, or an antigenically-effective portion or an oligopeptide thereof, to induce an immune response; 2) engineering hybridomas to produce monoclonal antibodies; 3) inducing in vivo production in the lymphocyte population; or 4) screening libraries of recombinant immunoglobulins. Recombinant immunoglobulins may be produced as taught in U.S. Pat. No. 4,816,567.

Antibodies produced using the proteins of the invention are useful for the diagnosis of prepathologic disorders as well as the diagnosis of chronic or acute diseases characterized by abnormalities in the expression, amount, or distribution of the protein. A variety of protocols for competitive binding or immunoradiometric assays using either polyclonal or monoclonal antibodies specific for proteins are well known in the art. Immunoassays typically involve the formation of complexes between a protein and its specific binding molecule or compound and the measurement of complex formation. Immunoassays may employ a two-site, monoclonal-based assay that utilizes monoclonal antibodies reactive to two noninterfering epitopes on a specific protein or a competitive binding assay (Pound (1998) *Immunochemical Protocols,* Humana Press, Totowa N.J.).

Immunoassay procedures may be used to quantify expression of the protein in cell cultures, in subjects with a particular disorder or in model animal systems under various conditions. Increased or decreased production of proteins as monitored by immunoassay may contribute to knowledge of the cellular activities associated with developmental pathways, engineered conditions or diseases, or treatment efficacy. The quantity of a given protein in a given tissue may be determined by performing immunoassays on freeze-thawed detergent extracts of biological samples and comparing the slope of the binding curves to binding curves generated by purified protein.

Labeling of Molecules for Assay

A wide variety of reporter molecules and conjugation techniques are known by those skilled in the art and may be used in various cDNA, polynucleotide, protein, peptide or antibody assays. Synthesis of labeled molecules may be achieved using commercial kits for incorporation of a labeled nucleotide such as $^{32}$P-dCTP, Cy3-dCTP or Cy5-dCTP or amino acid such as $^{35}$S-methionine. Polynucleotides, cDNAs, proteins, or antibodies may be directly labeled with a reporter molecule by chemical conjugation to amines, thiols and other groups present in the molecules using reagents such as BIODIPY or FITC (Molecular Probes, Eugene Oreg.).

The proteins and antibodies may be labeled for purposes of assay by joining them, either covalently or noncovalently, with a reporter molecule that provides for a detectable signal. A wide variety of labels and conjugation techniques are known and have been reported in the scientific and patent literature including, but not limited to U.S. Pat. Nos. 3,817,837; 3,850,752; 3,939,350; 3,996,345; 4,277,437; 4,275,149; and 4,366,241.

Diagnostics

The cDNAs, or fragments thereof, may be used to detect and quantify differential gene expression; absence, presence, or excess expression of mRNAs; or to monitor mRNA levels during therapeutic intervention. Disorders associated with altered expression include hyperlipidemia, hypertension, type II diabetes, and tumors of the liver. These cDNAs can also be utilized as markers of treatment efficacy against the disorders noted above and other liver disorders, conditions, and diseases over a period ranging from several days to months. The diagnostic assay may use hybridization or amplification technology to compare gene expression in a biological sample from a patient to standard samples in order to detect altered gene expression. Qualitative or quantitative methods for this comparison are well known in the art.

For example, the cDNA may be labeled by standard methods and added to a biological sample from a patient under conditions for hybridization complex formation. After an incubation period, the sample is washed and the amount of label (or signal) associated with hybridization complexes is quantified and compared with a standard value. If the amount of label in the patient sample is significantly altered in comparison to the standard value, then the presence of the associated condition, disease or disorder is indicated.

In order to provide a basis for the diagnosis of a condition, disease or disorder associated with gene expression, a normal or standard expression profile is established. This may be accomplished by combining a biological sample taken from normal subjects, either animal or human, with a probe under conditions for hybridization or amplification. Standard hybridization may be quantified by comparing the values obtained using normal subjects with values from an experiment in which a known amount of a substantially purified target sequence is used. Standard values obtained in this manner may be compared with values obtained from samples from patients who are symptomatic for a particular condition, disease, or disorder. Deviation from standard values toward those associated with a particular condition is used to diagnose that condition.

Such assays may also be used to evaluate the efficacy of a particular therapeutic treatment regimen in animal studies and in clinical trial or to monitor the treatment of an individual patient. Once the presence of a condition is established and a treatment protocol is initiated, diagnostic assays may be repeated on a regular basis to determine if the level of expression in the patient begins to approximate that which is observed in a normal subject. The results obtained from successive assays may be used to show the efficacy of treatment over a period ranging from several days to months.

Gene Expression Profiles

A gene expression profile comprises a plurality of cDNAs and a plurality of detectable hybridization complexes, wherein each complex is formed by hybridization of one or more probes to one or more complementary sequences in a sample. The cDNA composition of the invention is used as elements on a microarray to analyze gene expression profiles. In one embodiment, the microarray is used to monitor the progression of disease. Researchers can assess and catalog the differences in gene expression between healthy and diseased tissues or cells. By analyzing changes in patterns of gene expression, disease can be diagnosed at earlier stages before the patient is symptomatic. The invention can be used to formulate a prognosis and to design a treatment regimen. The invention can also be used to monitor the efficacy of treatment. For treatments with known side effects, the microarray is employed to improve the treatment regimen. A dosage is established that causes a change in genetic expression patterns indicative of successful treatment. Expression patterns associated with the onset of undesirable side effects are avoided. This approach may be more sensitive and rapid than waiting for the patient to show inadequate improvement, or to manifest side effects, before altering the course of treatment.

In another embodiment, animal models which mimic a human disease can be used to characterize expression profiles associated with a particular condition, disorder or disease; or treatment of the condition, disorder or disease. Novel treatment regimens may be tested in these animal models using microarrays to establish and then follow expression profiles over time. In addition, microarrays may be used with cell cultures or tissues removed from animal models to rapidly screen large numbers of candidate drug molecules, looking for ones that produce an expression profile similar to those of known therapeutic drugs, with the expectation that molecules with the same expression profile will likely have similar therapeutic effects. Thus, the invention provides the means to rapidly determine the molecular mode of action of a drug.

Assays Using Antibodies

Antibodies directed against epitopes on a protein encoded by a cDNA of the invention may be used in assays to quantify the amount of protein found in a particular human cell. Such assays include methods utilizing the antibody and a label to detect expression level under normal or disease conditions. The antibodies may be used with or without modification, and labeled by joining them, either covalently or noncovalently, with a labeling moiety.

Protocols for detecting and measuring protein expression using either polyclonal or monoclonal antibodies are well known in the art. Examples include ELISA, RIA, and fluorescent activated cell sorting (FACS). Such immunoassays typically involve the formation of complexes between the protein and its specific antibody and the measurement of such complexes. These and other assays are described in Pound (supra). The method may employ a two-site, monoclonal-based immunoassay utilizing monoclonal antibodies reactive to two non-interfering epitopes, or a competitive binding assay. (See, e.g., Coligan et al. (1997) *Current Protocols in Immunology*, Wiley-Interscience, New York N.Y.; Pound, supra)

Therapeutics

The cDNAs and fragments thereof can be used in gene therapy. cDNAs can be delivered ex vivo to target cells, such as cells of bone marrow. Once stable integration and transcription and or translation are confirmed, the bone marrow may be reintroduced into the subject. Expression of the protein encoded by the cDNA may correct a disorder associated with mutation of a normal sequence, reduction or loss of an endogenous target protein, or overepression of an endogenous or mutant protein. Alternatively, cDNAs may be delivered in vivo using vectors such as retrovirus, adenovirus, adeno-associated virus, herpes simplex virus, and bacterial plasmids. Non-viral methods of gene delivery include cationic liposomes, polylysine conjugates, artificial viral envelopes, and direct injection of DNA (Anderson (1998) Nature 392:25–30; Dachs et al. (1997) Oncol Res 9:313–325; Chu et al. (1998) J Mol Med 76(34):184Weiss et al. (1999) Cell Mol Life Sci 55(3):334–358; Agrawal (1996) *Antisense Therapeutics*, Humana Press, Totowa N.J.; and August et al. (1997) *Gene Therapy* (*Advances in Pharmacology. Vol.* 40), Academic Press, San Diego Calif.).

In addition, expression of a particular protein can be regulated through the specific binding of a fragment of a cDNA to a genomic sequence or an mRNA which encodes the protein or directs its transcription or translation. The cDNA can be modified or derivatized to any RNA-like or DNA-like material including peptide nucleic acids, branched nucleic acids, and the like. These sequences can be produced biologically by transforming an appropriate host cell with a vector containing the sequence of interest.

Molecules which regulate the activity of the cDNA or encoded protein are useful as therapeutics for hyperlipidemia. Such molecules include agonists which increase the expression or activity of the polynucleotide or encoded protein, respectively; or antagonists which decrease expression or activity of the polynucleotide or encoded protein, respectively. In one aspect, an antibody which specifically binds the protein may be used directly as an antagonist or indirectly as a delivery mechanism for bringing a pharmaceutical agent to cells or tissues which express the protein.

Additionally, any of the proteins, or their ligands, or complementary nucleic acid sequences may be administered as pharmaceutical compositions or in combination with other appropriate therapeutic agents. Selection of the appropriate agents for use in combination therapy may be made by one of ordinary skill in the art, according to conventional pharmaceutical principles. The combination of therapeutic agents may act synergistically to affect the treatment or prevention of the conditions and disorders associated with an immune response. Using this approach, one may be able to achieve therapeutic efficacy with lower dosages of each agent, thus reducing the potential for adverse side effects. Further, the therapeutic agents may be combined with pharmaceutically-acceptable carriers including excipients and auxiliaries which facilitate processing of the active compounds into preparations which can be used pharmaceutically. Further details on techniques for formulation and administration used by doctors and pharmacists may be found in the latest edition of *Remington's Pharmaceutical Sciences* (Maack Publishing, Easton Pa.).

Model Systems

Animal models may be used as bioassays where they exhibit a phenotypic response similar to that of humans and where exposure conditions are relevant to human exposures. Mammals are the most common models, and most infectious agent, cancer, drug, and toxicity studies are performed on rodents such as rats or mice because of low cost, availability, lifespan, reproductive potential, and abundant reference literature. Inbred and outbred rodent strains provide a convenient model for investigation of the physiological consequences of underexpression or overexpression of genes of interest and for the development of methods for diagnosis and treatment of diseases. A mammal inbred to overexpress a particular gene (for example, secreted in milk) may also serve as a convenient source of the protein expressed by that gene.

Transgenic Animal Models

Transgenic rodents that overexpress or underexpress a gene of interest may be inbred and used to model human diseases or to test therapeutic or toxic agents. (See, e.g., U.S. Pat. Nos. 5,175,383 and 5,767,337.) In some cases, the introduced gene may be activated at a specific time in a specific tissue type during fetal or postnatal development. Expression of the transgene is monitored by analysis of phenotype, of tissue-specific mRNA expression, or of serum and tissue protein levels in transgenic animals before, during, and after challenge with experimental drug therapies.

Embryonic Stem Cells

Embryonic (ES) stem cells isolated from rodent embryos retain the potential to form embryonic tissues. When ES cells such as the mouse 129/SvJ cell line are placed in a blastocyst from the C57BL/6 mouse strain, they resume normal development and contribute to tissues of the liveborn animal. ES cells are preferred for use in the creation of experimental knockout and knockin animals. The method for this process is well known in the art and the steps are: the cDNA is introduced into a vector, the vector is transformed into ES cells, transformed cells are identified and microinjected into mouse cell blastocysts, blastocysts are surgically transferred to pseudopregnant dams. The resulting chimeric progeny are genotyped and bred to produce heterozygous or homozygous strains.

Knockout Analysis

In gene knockout analysis, a region of a gene is enzymatically modified to include a non-natural intervening sequence such as the neomycin phosphotransferase gene (neo; Capecchi (1989) Science 244:1288–1292). The modified gene is transformed into cultured ES cells and integrates into the endogenous genome by homologous recombination. The inserted sequence disrupts transcription and translation of the endogenous gene.

Knockin Analysis

ES cells can be used to create knockin humanized animals or transgenic animal models of human diseases. With knockin technology, a region of a human gene is injected into animal ES cells, and the human sequence integrates into the animal cell genome. Transgenic progeny or inbred lines are studied and treated with potential pharmaceutical agents to obtain information on the progression and treatment of the analogous human condition.

As described herein, the uses of the cDNAs, provided in the Sequence Listing of this application, and their encoded proteins are exemplary of known techniques and are not intended to reflect any limitation on their use in any technique that would be known to the person of average skill in the art. Furthermore, the cDNAs provided in this application may be used in molecular biology techniques that have not yet been developed, provided the new techniques rely on properties of nucleotide sequences that are currently known to the person of ordinary skill in the art, e.g., the triplet genetic code, specific base pair interactions, and the like. Likewise, reference to a method may include combining more than one method for obtaining or assembling full length cDNA sequences that will be known to those skilled in the art. It is also to be understood that this invention is not limited to the particular methodology, protocols, and reagents described, as these may vary. It is also understood that the terminology used herein is for the purpose of describing particular embodiments only, and is not intended to limit the scope of the present invention which will be limited only by the appended claims. The examples below are provided to illustrate the subject invention and are not included for the purpose of limiting the invention.

EXAMPLES

I Construction of cDNA Libraries

RNA was purchased from Clontech Laboratories (Palo Alto Calif.) or isolated from various tissues. Some tissues were homogenized and lysed in guanidinium isothiocyanate, while others were homogenized and lysed in phenol or in a suitable mixture of denaturants, such as TRIZOL reagent (Life Technologies, Rockville Md.). The resulting lysates were centrifuged over CsCl cushions or extracted with chloroform. RNA was precipitated with either isopropanol or ethanol and sodium acetate, or by other routine methods. Phenol extraction and precipitation of RNA were repeated as necessary to increase RNA purity. In most cases, RNA was treated with DNase. For most libraries, poly(A) RNA was isolated using oligo d(T)-coupled paramagnetic particles (Promega), OLIGOTEX latex particles (Qiagen, Valencia Calif.), or an OLIGOTEX mRNA purification kit (Qiagen). Alternatively, poly(A) RNA was isolated directly from tissue lysates using other kits, including the POLY(A)PURE mRNA purification kit (Ambion, Austin Tex.).

In some cases, Stratagene (La Jolla Calif.) was provided with RNA and constructed the corresponding cDNA libraries. Otherwise, cDNA was synthesized and cDNA libraries were constructed with the UNIZAP vector system (Stratagene) or SUPERSCRIPT plasmid system (Life Technologies) using the recommended procedures or similar methods known in the art. (See Ausubel, supra, Units 5.1 through 6.6.) Reverse transcription was initiated using oligo d(T) or random primers. Synthetic oligonucleotide adapters were ligated to double stranded cDNA, and the cDNA was digested with the appropriate restriction enzyme or enzymes. For most libraries, the cDNA was size-selected (300–1000 bp) using SEPHACRYL S1000, SEPHAROSE CL2B, or SEPHAROSE CL4B column chromatography (APB) or preparative agarose gel electrophoresis. cDNAs were ligated into compatible restriction enzyme sites of the polylinker of the PBLUESCRIPT phagemid (Stratagene), PSPORT1 plasmid (Life Technologies), or PINCY plasmid (Incyte Genomics). Recombinant plasmids were transformed into XL1-BLUE, XL1-BLUEMRF, or SOLR competent E. coli cells (Stratagene) or DH5a, DH10B, or ELECTROMAX DH10B competent E. coli cells (Life Technologies).

In some cases, libraries were superinfected with a 5×excess of the helper phage, M13K07, according to the method of Vieira et al. (1987, Methods Enzymol. 153:3–11) and normalized or subtracted using a methodology adapted from Soares (1994, Proc Natl Acad Sci 91:9228–9232), Swaroop et al. (1991, Nucl Acids Res 19:1954), and Bonaldo et al. (1996, Genome Research 6:791–806). The modified Soares normalization procedure was utilized to reduce the repetitive cloning of highly expressed high abundance cDNAs while maintaining the overall sequence complexity of the library. Modification included significantly longer hybridization times which allowed for increased gene discovery rates by biasing the normalized libraries toward those infrequently expressed low-abundance cDNAs which are poorly represented in a standard transcript image (Soares et al., supra).

II Isolation and Sequencing of cDNA Clones

Plasmids were recovered from host cells by in vivo excision using the UNIZAP vector system (Stratagene) or by cell lysis. Plasmids were purified using one of the following: the Magic or WIZARD MINIPREPS DNA purification system (Promega); the AGTC MINIPREP purification kit (Edge BioSystems, Gaithersburg Md.); the QIAWELL 8, QIAWELL 8 Plus, or QIAWELL 8 Ultra plasmid purification systems, or the REAL PREP 96 plasmid purification kit (QIAGEN). Following precipitation, plasmids were resuspended in 0.1 ml of distilled water and stored, with or without lyophilization, at 4° C.

Alternatively, plasmid DNA was amplified from host cell lysates using direct link PCR in a high-throughput format (Rao (1994) Anal Biochem 216:1–14). Host cell lysis and thermal cycling steps were carried out in a single reaction mixture. Samples were processed and stored in 384-well plates, and the concentration of amplified plasmid DNA was quantified fluorometrically using PICOGREEN dye (Molecular Probes) and a FLUOROSKAN II fluorescence scanner (Labsystems Oy, Helsinki, Finland).

cDNA sequencing reactions were processed using standard methods or high-throughput instrumentation such as the ABI CATALYST 800 thermal cycler (Applied Biosystems) or the DNA ENGINE thermal cycler (MJ Research, Watertown Mass.) in conjunction with the HYDRA microdispenser (Robbins Scientific, Sunnyvale Calif.) or the MICROLAB 2200 system (Hamilton, Reno Nev.). cDNA sequencing reactions were prepared using reagents provided by APB or supplied in ABI sequencing kits such as the ABI PRISM BIGDYE cycle sequencing kit (Applied Biosystems). Electrophoretic separation of cDNA sequencing reactions and detection of labeled cDNAs were carried out using the MEGABACE 1000 DNA sequencing system (APB); the ABI PRISM 373 or 377 sequencing systems (Applied Biosystems) in conjunction with standard ABI protocols and base calling software; or other sequence analysis systems known in the art. Reading frames within the cDNA sequences were identified using standard methods (reviewed in Ausubel, supra, Unit 7.7).

III Extension of cDNA Sequences

Nucleic acid sequences were extended using the cDNA clones and oligonucleotide primers. One primer was synthesized to initiate 5' extension of the known fragment, and the other, to initiate 3' extension of the known fragment. The initial primers were designed using OLIGO 4.06 software (National Biosciences), or another appropriate program, to be about 22 to 30 nucleotides in length, to have a GC content of about 50% or more, and to anneal to the target sequence at temperatures of about 68° C. to about 72° C. Any stretch of nucleotides which would result in hairpin structures and primer-primer dimerizations was avoided.

Selected human cDNA libraries were used to extend the sequence. If more than one extension was necessary or desired, additional or nested sets of primers were designed. Preferred libraries are ones that have been size-selected to include larger cDNAs. Also, random primed libraries are preferred because they will contain more sequences with the 5' and upstream regions of genes. A randomly primed library is particularly useful if an oligo d(T) library does not yield a full-length cDNA.

High fidelity amplification was obtained by PCR using methods well known in the art. PCR was performed in 96-well plates using the DNA ENGINE thermal cycler (MJ Research). The reaction mix contained DNA template, 200 nmol of each primer, reaction buffer containing $Mg^{2+}$, $(NH_4)_2SO_4$, and β-mercaptoethanol, Taq DNA polymerase (APB), ELONGASE enzyme (Life Technologies), and Pfu DNA polymerase (Stratagene), with the following parameters for primer pair PCI A and PCI B (Incyte Genomics): Step 1: 94° C., 3 min; Step 2:94° C., 15 sec; Step 3:60° C., 1 min; Step 4:68° C., 2 min; Step 5: Steps 2, 3, and 4 repeated 20 times; Step 6:68° C., 5 min; Step 7: storage at 4° C. In the alternative, the parameters for primer pair T7 and SK+(Stratagene) were as follows: Step 1:94° C., 3 min; Step 2:94° C., 15 sec; Step 3:57° C., 1 min; Step 4:68° C., 2 min; Step 5: Steps 2, 3, and 4 repeated 20 times ; Step 6: 68° C., 5 min; Step 7: storage at 4° C.

The concentration of DNA in each well was determined by dispensing 100 μl PICOGREEN reagent (0.25% reagent in 1×x TE, v/v; Molecular Probes) and 0.5 μl of undiluted PCR product into each well of an opaque fluorimeter plate (Corning Costar, Acton Mass.) and allowing the DNA to bind to the reagent. The plate was scanned in a FLUOROSKAN II (Labsystems Oy) to measure the fluorescence of the sample and to quantify the concentration of DNA. A 5 μl to 10 μl aliquot of the reaction mixture was analyzed by electrophoresis on a 1% agarose mini-gel to determine which reactions were successful in extending the sequence.

The extended nucleic acids were desalted and concentrated, transferred to 384-well plates, digested with CviJI cholera virus endonuclease (Molecular Biology Research, Madison Wis.), and sonicated or sheared prior to religation into pUC18 vector (APB). For shotgun sequencing, the digested nucleic acids were separated on low concentration (0.6 to 0.8%) agarose gels, fragments were excised, and agar digested with AGARACE enzyme (Promega). Extended clones were religated using T4 DNA ligase (New England Biolabs, Beverly Mass.) into pUC18 vector (APB), treated with Pfu DNA polymerase (Stratagene) to fill-in restriction site overhangs, and transformed into competent E. coli cells. Transformed cells were selected on antibiotic-containing media, and individual colonies were picked and cultured overnight at 37° C. in 384-well plates in LB/2×carbenicillin liquid media.

The cells were lysed, and DNA was amplified by PCR using Taq DNA polymerase (APB) and Pfu DNA polymerase (Stratagene) with the following parameters: Step 1:94° C., 3 min; Step 2:94° C., 15 sec; Step 3: 60° C., 1 min; Step 4:72° C., 2 min; Step 5: steps 2, 3, and 4 repeated 29 times; Step 6: 72° C., 5 min; Step 7: storage at 4° C. DNA was quantified using PICOGREEN reagent (Molecular Probes) as described above. Samples with low DNA recoveries were reamplified using the same conditions described above. Samples were diluted with 20% dimethylsulfoxide (DMSO; 1:2, v/v), and sequenced using DYENAMIC energy transfer sequencing primers and the DYENAMIC DIRECT cycle sequencing kit (APB) or the ABI PRISM BIGDYE terminator cycle sequencing kit (Applied Biosystems).

IV Assembly and Analysis of Sequences

Component nucleotide sequences from chromatograms were subjected to PHRED analysis (Phil Green, University of Washington, Seattle Wash.) and assigned a quality score. The sequences having at least a required quality score were subject to various pre-processing algorithms to eliminate low quality 3' ends, vector and linker sequences, polyA tails, Alu repeats, mitochondrial and ribosomal sequences, bacterial contamination sequences, and sequences smaller than 50 base pairs. Sequences were screened using the BLOCK 2 program (Incyte Genomics), a motif analysis program based on sequence information contained in the SWISS-PROT and PROSRIT databases (Bairoch et al. (1997) Nucleic Acids Res 25:217–221; Attwood et al. (1997) J Chem Inf Comput Sci 37:417–424).

Processed sequences were subjected to assembly procedures in which the sequences were assigned to bins, one sequence per bin. Sequences in each bin were assembled to produce consensus sequences, templates. Subsequent new sequences were added to existing bins using BLAST (Altschul (supra); Altschul et al. (supra); Karlin et al. (1988) Proc Natl Acad Sci 85–841–845), BLASTn (vers. 1.4, WashU), and CROSSMATCH software (Phil Green, supra). Candidate pairs were identified as all BLAST hits having a quality score greater than or equal to 150. Alignments of at least 82% local identity were accepted into the bin. The component sequences from each bin were assembled using PHRAP (Phil Green, supra). Bins with several overlapping component sequences were assembled using DEEP PHRAP (Phil Green, supra).

Bins were compared against each other, and those having local similarity of at least 82% were combined and reassembled. Reassembled bins having templates of insufficient overlap (less than 95% local identity) were re-split. Assembled templates were also subjected to analysis by STITCHER/EXON MAPPER algorithms which analyzed the probabilities of the presence of splice variants, alternatively spliced exons, splice junctions, differential expression of alternative spliced genes across tissue types, disease states, and the like. These resulting bins were subjected to several rounds of the above assembly procedures to generate the template sequences found in the LIFESEQ GOLD database (Incyte Genomics).

The assembled templates were annotated using the following procedure. Template sequences were analyzed using BLASTn (vers. 2.0, NCBI) versus GBpri (GenBank vers. 116). "Hits" were defined as an exact match having from 95% local identity over 200 base pairs through 100% local identity over 100 base pairs, or a homolog match having an E-value equal to or greater than $1 \times 10^{-8}$. (The "E-value" quantifies the statistical probability that a match between two sequences occurred by chance). The hits were subjected to frameshift FASTxversus GENPEPT (GenBank version 109). In this analysis, a homolog match was defined as having an E-value of $1 \times 10^{-8}$. The assembly method used above was described in U.S. Ser. No. 09/276,534, filed Mar. 25, 1999, and the LIFESEQ GOLD user manual (Incyte Genomics).

Following assembly, template sequences were subjected to motif, BLAST, Hidden Markov Model (HMM; Pearson and Lipman (1988) Proc Natl Acad Sci 85:2444–2448; Smith and Waterman (1981) J Mol Biol 147:195–197), and functional analyses, and categorized in protein hierarchies using methods described in U.S. Ser. No. 08/812,290, filed Mar. 6, 1997; U.S. Ser. No. 08/947,845, filed Oct. 9, 1997; U.S. Pat. No. 5,953,727; and U.S. Ser. No. 09/034,807, filed Mar.4, 1998. Template sequences may be further queried against public databases such as the GenBank rodent, mammalian, vertebrate, eukaryote, prokaryote, and human EST databases.

V Selection of Sequences, Microarray Preparation and Use

Incyte clones represent template sequences derived from the LIFESEQ GOLD assembled human sequence database (Incyte Genomics). In cases where more than one clone was available for a particular template, the 5'-most clone in the template was used on the microarray. The GENEALBUM GEM series 1–6 microarrays (Incyte Genomics) contain 52,616 array elements which represent 17,472 annotated clusters and 35,144 unannotated clusters. The HUMAN GENOME GEM series 1–3 microarrays (Incyte Genomics) contain 28,626 array elements which represent 10,068 annotated clusters and 18,558 unannotated clusters. For the UNIGEM series microarrays (Incyte Genomics), Incyte clones were mapped to non-redundant Unigene clusters (Unigene database (build 46), NCBI; Shuler (1997) J Mol Med 75:694–698), and the 5' clone with the strongest BLAST alignment (at least 90% identity and 100 bp overlap) was chosen, verified, and used in the construction of the microarray. The UNIGEM V microarray (Incyte Genomics) contains 7075 array elements which represent 4610 annotated genes and 2,184 unannotated clusters. Table 3 shows the GenBank annotations for SEQ ID NOs: 1–401 of this invention as produced by BLAST analysis.

To construct microarrays, cDNAs were amplified from bacterial cells using primers complementary to vector sequences flanking the cDNA insert. Thirty cycles of PCR increased the initial quantity of cDNAs from 1–2 ng to a final quantity greater than 5 µg. Amplified cDNAs were then purified using SEPHACRYL-400 columns (APB). Purified cDNAs were immobilized on polymer-coated glass slides. Glass microscope slides (Corning, Corning N.Y.) were cleaned by ultrasound in 0.1% SDS and acetone, with extensive distilled water washes between and after treatments. Glass slides were etched in 4% hydrofluoric acid (VWR Scientific Products, West Chester Pa.), washed thoroughly in distilled water, and coated with 0.05% aminopropyl silane (Sigma Aldrich) in 95% ethanol. Coated slides were cured in a 110° C. oven. cDNAs were applied to the coated glass substrate using a procedure described in U.S. Pat. No. 5,807,522. One microliter of the cDNA at an average concentration of 100 ng/ul was loaded into the open capillary printing element by a high-speed robotic apparatus which then deposited about 5 nl of cDNA per slide.

Microarrays were UV-crosslinked using a STRATALINKER UV-crosslinker (Stratagene), and then washed at room temperature once in 0.2% SDS and three times in distilled water. Non-specific binding sites were blocked by incubation of microarrays in 0.2% casein in phosphate buffered saline (Tropix, Bedford Mass.) for 30 minutes at 60° C. followed by washes in 0.2% SDS and distilled water as before.

VI Preparation of Samples

Treatment of Human C3A Cell Cultures

Early confluent C3A cells (ATTC, Manassas Va.) were treated with captopril (0.5, 2, 48, and 60 µg/ml) for 1, 3, and 6 hours. Early confluent C3A cells were treated with enalapril (0.5, 2, 48, and 60 µg/ml) for 1, 3, and 6 hours. Early confluent C3A cells were treated with LY294002 (0.5, 2, 15, and 25 µg/ml) for 1, 3, and 6 hours. Early confluent C3A cells were starved of insulin for 3 days prior to treatment, then treated with LY294002 (10 µM) for 2, 24, 36, and 72 hours in the presence of insulin. Early confluent C3A cells were treated with DES (1, 10, and 100 µM) for 1, 3, and 6 hours. Early confluent C3A cells were treated with dexamethasone (1 and 20 µM) for 0, 2, 6, and 24 hours. Early confluent C3A cells were treated with MCA (0.5 and 10 µM) for 2, 6, and 24 hours. In all cases mRNA from untreated early confluent cells were prepared in parallel as described below.

Isolation and Labeling of Sample cDNAs

Cells were harvested and lysed in 1 ml of TRIZOL reagent ($5 \times 10^6$ cells/ml; Life Technologies). The lysates were vortexed thoroughly and incubated at room temperature for 2–3 minutes and extracted with 0.5 ml chloroform. The extract was mixed, incubated at room temperature for 5 minutes, and centrifuged at 15,000 rpm for 15 minutes at 4° C. The aqueous layer was collected and an equal volume of isopropanol was added. Samples were mixed, incubated at room temperature for 10 minutes, and centrifuged at 15,000 rpm for 20 minutes at 4° C. The supernatant was removed and the RNA pellet was washed with 1 ml of 70% ethanol, centrifuged at 15,000 rpm at 4° C., and resuspended in RNase-free water. The concentration of the RNA was determined by measuring the optical density at 260 nm.

Poly(A) RNA was prepared using an OLIGOTEX mRNA kit (QIAGEN) with the following modifications: OLIGOTEX beads were washed in tubes instead of on spin columns, resuspended in elution buffer, and then loaded onto spin columns to recover mRNA. To obtain maximum yield, the mRNA was eluted twice.

Each poly(A) RNA sample was reverse transcribed using MMLV reverse-transcriptase, 0.05 pg/µl oligo-d(T) primer (21mer), 1×first strand buffer, 0.03 units/ul RNase inhibitor, 500 uM dATP, 500 uM dGTP, 500 uM dTTP, 40 uM dCTP, and 40 uM either dCTP-Cy3 or dCTP-Cy5 (APB). The reverse transcription reaction was performed in a 25 ml volume containing 200 ng poly(A) RNA using the GEM-BRIGHT kit (Incyte Genomics). Specific control poly(A) RNAs (YCFR06, YCFR45, YCFR67, YCFR85, YCFR43, YCFR22, YCFR23, YCFR25, YCFR44, YCFR26) were synthesized by in vitro transcription from non-coding yeast genomic DNA (W. Lei, unpublished). As quantitative controls, control lnRNAs (YCFR06, YCFR45, YCFR67, and YCFR85) at 0.002 ng, 0.02 ng, 0.2 ng, and 2 ng were diluted into reverse transcription reaction at ratios of 1:100,000, 1:10,000, 1:1000, 1:100 (w/w) to sample mRNA, respectively. To sample differential expression patterns, control mRNAs (YCFR43, YCFR22, YCFR23, YCFR25, YCFR44, YCFR26) were diluted into reverse transcription reaction at ratios of 1:3, 3:1, 1:10, 10:1, 1:25, 25:1 (w/w) to sample mRNA. Reactions were incubated at 37° C. for 2 hr, treated with 2.5 ml of 0.5M sodium hydroxide, and incubated for 20 minutes at 85° C. to the stop the reaction and degrade the RNA.

cDNAs were purified using two successive CHROMA SPIN 30 gel filtration spin columns (Clontech). Cy3- and Cy5-labeled reaction samples were combined as described below and ethanol precipitated using 1 ml of glycogen (1 mg/ml), 60 ml sodium acetate, and 300 ml of 100% ethanol. The cDNAs were then dried to completion using a Speed-VAC system (Savant Instruments, Holbrook N.Y.) and resuspended in 14 µl 5×SSC/0.2% SDS.

VII Hybridization and Detection

Hybridization reactions contained 9 µl of sample mixture containing 0.2 µg each of Cy3 and Cy5 labeled cDNA synthesis products in 5×SSC, 0.2% SDS hybridization buffer. The mixture was heated to 65° C. for 5 minutes and was aliquoted onto the microarray surface and covered with an 1.8 cm$^2$ coverslip. The microarrays were transferred to a waterproof chamber having a cavity just slightly larger than a microscope slide. The chamber was kept at 100% humidity internally by the addition of 140 µl of 5×SSC in a corner of the chamber. The chamber containing the microarrays was incubated for about 6.5 hours at 60° C. The microarrays were washed for 10 min at 45° C. in low stringency wash buffer (1×SSC, 0.1% SDS), three times for 10 minutes each at 45° C. in high stringency wash buffer (0.1×SSC), and dried.

Reporter-labeled hybridization complexes were detected with a microscope equipped with an Innova 70 mixed gas 10 W laser (Coherent, Santa Clara Calif.) capable of generating spectral lines at 488 nm for excitation of Cy3 and at 632 nm for excitation of Cy5. The excitation laser light was focused on the microarray using a 20×microscope objective (Nikon, Melville N.Y.). The slide containing the microarray was placed on a computer-controlled X-Y stage on the microscope and raster-scanned past the objective. The 1.8 cm×1.8 cm microarray used in the present example was scanned with a resolution of 20 micrometers.

In two separate scans, the mixed gas multiline laser excited the two fluorophores sequentially. Emitted light was split, based on wavelength, into two photomultiplier tube detectors (PMT R1477; Hamamatsu Photonics Systems, Bridgewater N.J.) corresponding to the two fluorophores. Appropriate filters positioned between the microarray and the photomultiplier tubes were used to filter the signals. The emission maxima of the fluorophores used were 565 nm for Cy3 and 650 nm for Cy5. Each microarray was typically scanned twice, one scan per fluorophore using the appropriate filters at the laser source, although the apparatus was capable of recording the spectra from both fluorophores simultaneously.

The sensitivity of the scans was calibrated using the signal intensity generated by a cDNA control species. Samples of the calibrating cDNA were separately labeled with the two fluorophores and identical amounts of each were added to the hybridization mixture. A specific location on the microarray contained a complementary DNA sequence, allowing the intensity of the signal at that location to be correlated with a weight ratio of hybridizing species of 1:100,000.

The output of the photomultiplier tube was digitized using a 12-bit RTI-835H analog-to-digital (A/D) conversion board (Analog Devices, Norwood, Mass.) installed in an IBM-compatible PC computer. The digitized data were displayed as an image where the signal intensity was mapped using a linear 20-color transformation to a pseudocolor scale ranging from blue (low signal) to red (high signal). The data was also analyzed quantitatively. Where two different fluorophores were excited and measured simultaneously, the data were first corrected for optical crosstalk (due to overlapping emission spectra) between the fluorophores using each fluorophore's emission spectrum.

A grid was superimposed over the fluorescence signal image such that the signal from each spot was centered in each element of the grid. The fluorescence signal within each element was then integrated to obtain a numerical value corresponding to the average intensity of the signal. The software used for signal analysis was the GEMTOOLS gene expression analysis program (Incyte Genomics). Significance was defined as signal to background ratio exceeding 2×and area hybridization exceeding 40%.

VIII Data Analysis and Results

Array elements that exhibited at least 2-fold change in expression at one or more time points, a signal intensity over 250 units, a signal-to-background ratio of at least 2.5, and an element spot size of at least 40% were identified as differentially expressed using the GEMTOOLS program (Incyte Genomics). The cDNAs that are differentially expressed are shown in Table 1. Table 1 identifies upregulated and downregulated cDNAs. The cDNAs are further identified by their SEQ ID NO and TEMPLATE ID, and by the description associated with at least a fragment of a polynucleotide found in GenBank as shown in Tables 2 and 3. The descriptions were obtained using the sequences of the Sequence Listing and BLAST analysis.

IX Other Hybridization Technologies and Analyses

Other hybridization technologies utilize a variety of substrates such as nylon membranes, capillary tubes, etc. Arranging cDNAs on polymer coated slides is described in Example V; sample cDNA preparation and hybridization and analysis using polymer coated slides is described in examples VI and VII, respectively.

The cDNAs are applied to a membrane substrate by one of the following methods. A mixture of cDNAs is fractionated by gel electrophoresis and transferred to a nylon membrane by capillary transfer. Alternatively, the cDNAs are individually ligated to a vector and inserted into bacterial host cells to form a library. The cDNAs are then arranged on a substrate by one of the following methods. In the first method, bacterial cells containing individual clones are robotically picked and arranged on a nylon membrane. The membrane is placed on LB agar containing selective agent (carbenicillin, kanamycin, ampicillin, or chloramphenicol depending on the vector used) and incubated at 37° C. for 16 hr. The membrane is removed from the agar and consecutively placed colony side up in 10% SDS, denaturing solution (1.5 M NaCl, 0.5 M NaOH), neutralizing solution (1.5 M NaCl, 1 M Tris, pH 8.0), and twice in 2×SSC for 10 min each. The membrane is then LTV irradiated in a STRATALINKER UV-crosslinker (Stratagene).

In the second method, cDNAs are amplified from bacterial vectors by thirty cycles of PCR using primers complementary to vector sequences flanking the insert. PCR amplification increases a starting concentration of 1–2 ng nucleic acid to a final quantity greater than 5 µg. Amplified nucleic acids from about 400 bp to about 5000 bp in length are purified using SEPHACRYL-400 beads (APB). Purified nucleic acids are arranged on a nylon membrane manually or using a dot/slot blotting manifold and suction device and are immobilized by denaturation, neutralization, and UV irradiation as described above.

Hybridization probes derived from cDNAs of the Sequence Listing are employed for screening cDNAs, mRNAs, or genomic DNA in membrane-based hybridizations. Probes are prepared by diluting the cDNAs to a concentration of 40–50 ng in 45 µl TE buffer, denaturing by heating to 100° C. for five min and briefly centrifuging. The denatured cDNA is then added to a REDIPRIME tube (APB), gently mixed until blue color is evenly distributed, and briefly centrifuged. Five microliters of $[^{32}P]dCTP$ is added to the tube, and the contents are incubated at 37° C. for 10 min. The labeling reaction is stopped by adding 5 µl of 0.2M EDTA, and probe is purified from unincorporated nucleotides using a PROBEQUANT G-50 microcolumn (APB). The purified probe is heated to 100° C. for five min and then snap cooled for two min on ice. Membranes are pre-hybridized in hybridization solution containing 1% Sarkosyl and 1×high phosphate buffer (0.5 M NaCl, 0.1 M $Na_2HP\ O_4$, 5 mM EDTA, pH 7) at 55° C. for two hr. The probe, dilut fresh hybridization solution, is then added to the membrane. The membrane is hybridized with the probe at 55° C. for 16 hr. Following hybridization, the membrane is washed for 15 min at 25° C. in 1 mM Tris (pH 8.0), 1% Sarkosyl, and four times for 15 min each at 25° C. in 1 mM Tris (pH 8.0). To detect hybridization complexes, XOMAT-AR film (Eastman Kodak, Rochester N.Y.) is exposed to the membrane overnight at −70° C., developed, and examined.

X Further Characterization of Differentially Expressed cDNAs and Proteins

Clones were blasted against the LIFESEQ Gold 5.1 database (Incyte Genomics) and an Incyte template and its sequence variants were chosen for each clone. The template and variant sequences were blasted against GenBank database to acquire annotation. The nucleotide sequences were translated into amino acid sequence which was blasted against the GenPept and other protein databases to acquire annotation and characterization, i.e., structural motifs.

Percent sequence identity can be determined electronically for two or more amino acid or nucleic acid sequences using the MEGALIGN program (DNASTAR). The percent identity between two amino acid sequences is calculated by dividing the length of sequence A, minus the number of gap residues in sequence A, minus the number of gap residues in sequence B, into the sum of the residue matches between sequence A and sequence B, times one hundred. Gaps of low or of no homology between the two amino acid sequences are not included in determining percentage identity.

Sequences with conserved protein motifs may be searched using the BLOCKS search program. This program analyses sequence information contained in the Swiss-Prot and PROSITE databases and is useful for determining the classification of uncharacterized proteins translated from genomic or cDNA sequences (Bairoch et al.(supra); Attwood et al. (supra). PROSITE database is a useful source for identifying functional or structural domains that are not detected using motifs due to extreme sequence divergence. Using weight matrices, these domains are calibrated against the SWISS-PROT database to obtain a measure of the chance distribution of the matches.

The PRINTS database can be searched using the BLIMPS search program to obtain protein family "fingerprints". The PRINTS database complements the PROSITE database by exploiting groups of aconserved motifs within sequence alignments to build characteristic signatures of different protein families. For both BLOCKS and PRINTS analyses, the cutoff scores for local similarity were: >1300=strong, 1000–1300=suggestive; for global similarity were: p<exp-3; and for strength (degree of correlation) were: >1300=strong, 1000–1300=weak.

X Expression of the Encoded Protein

Expression and purification of a protein encoded by a cDNA of the invention is achieved using bacterial or virus-based expression systems. For expression in bacteria, cDNA is subcloned into a vector containing an antibiotic resistance gene and an inducible promoter that directs high levels of cDNA transcription. Examples of such promoters include, but are not limited to, the trp-lac (tac) hybrid promoter and the T5 or T7 bacteriophage promoter in conjunction with the lac operator regulatory element. Recombinant vectors are transformed into bacterial hosts, such as BL21(DE3). Antibiotic resistant bacteria express the protein upon induction with IPTG. Expression in eukaryotic cells is achieved by infecting *Spodontera frugiperda* (Sf9) insect cells with recombinant baculovirus, *Autographica californica* nuclear polyhedrosis virus. The polyhedrin gene of baculovirus is replaced with the cDNA by either homologous recombination or bacterial-mediated transposition involving transfer plasmid intermediates. Viral infectivity is maintained and the strong polyhedrin promoter drives high levels of transcription.

For ease of purification, the protein is synthesized as a fusion protein with glutathione-S-transferase (GST; APB) or a similar alternative such as FLAG. The fusion protein is purified on immobilized glutathione under conditions that maintain protein activity and antigenicity. After purification, the GST moiety is proteolytically cleaved from the protein with thrombin. A fusion protein with FLAG, an 8-amino amino acid peptide, is purified using commercially available monoclonal and polyclonal anti-FLAG antibodies (Eastman Kodak, Rochester N.Y.).

XI Production of Specific Antibodies

A denatured protein from a reverse phase HPLC separation is obtained in quantities up to 75 mg. This denatured protein is used to immunize mice or rabbits following standard protocols. About 100 µg is used to immunize a mouse, while up to 1 mg is used to immunize a rabbit. The denatured protein is radioiodinated and incubated with murine B-cell hybridomas to screen for monoclonal antibodies. About 20 mg of protein is sufficient for labeling and screening several thousand clones.

In another approach, the amino acid sequence translated from a cDNA of the invention is analyzed using PROTEAN software (DNASTAR) to determine regions of high antigenicity, essentially antigenically-effective epitopes of the protein. The optimal sequences for immunization are usually at the C-terminus, the N-terminus, and those intervening, hydrophilic regions of the protein that are likely to be exposed to the external environment when the protein is in its natural conformation. Typically, oligopeptides about 15 residues in length are synthesized using an ABI 431 Peptide synthesizer (Applied Biosystems) using Fmoc-chemistry and then coupled to keyhole limpet hemocyanin (KLH; Sigma Aldrich) by reaction with M-maleimidobenzoyl-N-hydroxysuccinimide ester. If necessary, a cysteine may be introduced at the N-termninus of the peptide to permit coupling to KLH. Rabbits are immunized with the oligopeptide-KLH complex in complete Freund's adjuvant. The resulting antisera are tested for antipeptide activity by binding the peptide to plastic, blocking with 1% BSA, reacting with rabbit antisera, washing, and reacting with radioiodinated goat anti-rabbit IgG.

Hybridomas are prepared and screened using standard techniques. Hybridomas of interest are detected by screening with radioiodinated protein to identify those fusions producing a monoclonal antibody specific for the protein. In a typical protocol, wells of 96 well plates (FAST, Becton-Dickinson, Palo Alto Calif.) are coated with affinity-purified, specific rabbit-anti-mouse (or suitable anti-species Ig) antibodies at 10 mg/ml. The coated wells are blocked with 1% BSA and washed and exposed to supernatants from hybridomas. After incubation, the wells are exposed to radiolabeled protein at 1 mg/ml. Clones producing antibodies bind a quantity of labeled protein that is detectable above background.

Such clones are expanded and subjected to 2 cycles of cloning at 1 cell/3 wells. Cloned hybridomas are injected into pristane-treated mice to produce ascites, and monoclonal antibody is purified from the ascitic fluid by affinity chromatography on protein A (APB). Monoclonal antibodies with affinities of at least $10^8$ $M^{-1}$, preferably $10^9$ to $10^{10}$ $M^{-1}$ or stronger, are made by procedures well known in the art.

XII Purification of Naturally Occurring Protein Using Specific Antibodies

Naturally occurring or recombinant protein is substantially purified by immunoaffinity chromatography using antibodies specific for the protein. An immunoaffinity column is constructed by covalently coupling the antibody to CNBr-activated SEPHAROSE resin (APB). Media containing the protein is passed over the immunoaffinity column, and the column is washed using high ionic strength buffers in the presence of detergent to allow preferential absorbance of the protein. After coupling, the protein is eluted from the column using a buffer of pH 2–3 or a high concentration of urea or thiocyanate ion to disrupt antibody/protein binding, and the protein is collected.

XIII Screening Molecules for Specific Binding with the cDNA or Protein

The cDNA or fragments thereof and the protein or portions thereof are labeled with $^{32}$P-dCTP, Cy3-dCTP, Cy5-dCTP (APB), or BIODIPY or FITC (Molecular Probes), respectively. Candidate molecules or compounds previously arranged on a substrate are incubated in the presence of labeled nucleic or amino acid. After incubation under conditions for either a cDNA or a protein, the substrate is washed, and any position on the substrate retaining label, which indicates specific binding or complex formation, is assayed. The binding molecule is identified by its arrayed position on the substrate. Data obtained using different concentrations of the nucleic acid or protein are used to calculate affinity between the labeled nucleic acid or protein and the bound molecule. High throughput screening using very small assay volumes and very small amounts of test compound is fully described in Burbaum et al. U.S. Pat. No. 5,876,946.

All patents and publications mentioned in the specification are incorporated herein by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the described modes for carrying out the invention that are obvious to those skilled in the field of molecular biology or related fields are intended to be within the scope of the following claims.

TABLE 1

| Clone ID | Clofibrate | Fenofibrate | Captopril | Enalapril | Dexamethasone | DES | MCA | LY294002 | Ins/LY294002 |
|---|---|---|---|---|---|---|---|---|---|
| 26474 | | | | | −4.2 | | | | |
| 60123 | | | | | | 2.6 | | | |
| 63038 | −3.95 | −2.9 | −3.16 | −2.97 | −2.36 | | | | |
| 72713 | | | | | | | 3 | | |
| 85606 | | | | | | | 2.96 | | |
| 86390 | −2.83 | | | | | | | | |
| 118501 | 4.87 | | 4.36 | 6.06 | 2.79 | | 4.54 | | −2.4 |
| 121785 | | | | | | | 3.3 | | |
| 136073 | | | | | | | 3.1 | | |
| 160822 | | | 2.5 | 2.39 | | | | | |
| 167081 | | | | | 2.14 | | | | |
| 172023 | | | | | −5.8 | 2.85 | | −3.38 | |
| 211389 | | | −2.52 | | | | | | |
| 237027 | | | | | −2.85 | | | | |
| 293477 | | | | | | 2.83 | | | |
| 271299 | | | | | | | | | 2.91 |
| 279249 | | | | | | | | | −2.15 |
| 279898 | | | | | 4.08 | | 5.48 | 6.7 | |
| 280932 | −2.8 | −2.67 | | | | | | | |
| 293477 | | | | | | 2 | | | |
| 311346 | | | | | | | 4.59 | | |
| 318486 | | | | | | | 4.11 | | |
| 341884 | −2.32 | | | | | | | | −3.33 |
| 348143 | 2.11 | | | | | | | | |
| 388964 | | | | | | | | | 2.77 |
| 389362 | | | | | | | | | 2.88 |
| 407032 | −3.05 | | | | | | | | |
| 408886 | | | | | | | 4.93 | | |
| 419492 | | | | | | | | | 2.47 |
| 437481 | | 2.44 | | | | 2.24 | | | |
| 442723 | | | | | | | | | 2.51 |
| 443991 | | 2.47 | | | | 2.62 | | | |
| 450856 | | 2.49 | | | | | 2.89 | | |

TABLE 1-continued

| Clone ID | Clofibrate | Fenofibrate | Captopril | Enalapril | Dexamethasone | DES | MCA | LY294002 | Ins/LY294002 |
|---|---|---|---|---|---|---|---|---|---|
| 452321 | | 3 | | | | | 4.3 | | |
| 454839 | | | | | | | 3.4 | | |
| 459372 | | | | | | | | 4.65 | 2.63 |
| 460779 | 2.26 | | | | | | | | |
| 462069 | | | | | | | 2.41 | | |
| 480791 | | −2.27 | | | | | | | |
| 481402 | | | | | | | 3.22 | | |
| 510056 | | | | | | 2.73 | 5.65 | | |
| 511448 | | | | | | | 3.05 | | |
| 560115 | | | | | | | −2.61 | | |
| 604019 | | | | | | | 3.28 | | |
| 630625 | 2.53 | 3.95 | 2.81 | 2.51 | 2.52 | | 2.25 | | |
| 669498 | | | | | | | −2.97 | | |
| 701484 | | | | | | | 2.51 | | |
| 758192 | 3.11 | | | | | | | | |
| 773154 | | | | | | | | | −2.39 |
| 818192 | 2.87 | | | | | | | | |
| 872017 | | | | | | | 2.85 | | |
| 891322 | | | | | | 3.81 | | | |
| 963536 | | | | | | | | | 2.93 |
| 970905 | | −4.06 | | | | | 2.25 | | |
| 990375 | | | | | −2.5 | | | | |
| 1213932 | | | | | | | | | 6.31 |
| 1259841 | | | | | | | | | 3.15 |
| 1272483 | | | | | | 2.51 | | | |
| 1306814 | | | | | | | | | 2.83 |
| 1308112 | 2.19 | | | 2.14 | | | 2.28 | | |
| 1315663 | −3.18 | −4.02 | −2.84 | | | | | −3.27 | |
| 1316801 | | | | | | | 3.38 | | |
| 1326255 | | | | | | −2.7 | | | |
| 1368834 | | | 2.47 | 2.43 | | | | | |
| 1379063 | −2.38 | | −4 | −2.44 | −3.42 | | −3.63 | | |
| 1381654 | | | 1.57 | | 2.57 | | 2.64 | | |
| 1395143 | | | | | | | | | 3.09 |
| 1435374 | | | | | | | | | 3.67 |
| 1441245 | | | | | −2.3 | | | | |
| 1448718 | −2.95 | | −3.93 | −3.91 | −3.1 | | | | |
| 1454436 | | | | | | | | | 2.62 |
| 1457424 | | | | | | | 2.93 | | |
| 1457718 | | | | | | | | | 2.92 |
| 1464613 | −2.39 | | | | | | | | |
| 1468660 | | | | | −3.3 | | | −2.28 | |
| 1482116 | | | | | | | | | 3.44 |
| 1495382 | | | | | | | | | −2.77 |
| 1500245 | | | | | | | | | 2.92 |
| 1511658 | −3.56 | | | | | | | | |
| 1519431 | | | 2.36 | | | | | | |
| 1519683 | −2.12 | | | | | | | | |
| 1522880 | | | | | | | 2.74 | | |
| 1530595 | | | | | | | | | 3.52 |
| 1559665 | −4.058 | | | | | | | | |
| 1559756 | | | 1.56 | | 2.47 | | | | |
| 1560906 | | | | | | | 3.13 | | |
| 1577614 | | | | | | | | | −3.3 |
| 1616783 | | | | | 2.55 | | 2.63 | | |
| 1619292 | −3.07 | −5 | −4.3 | | −4.4 | | −2.8 | | |
| 1619980 | | | | | | | | | −2.97 |
| 1623214 | | | | | −2.25 | | −3.12 | | |
| 1630990 | | | | | 2.86 | | 3.34 | | |
| 1696224 | 11.91 | | 3.28 | 3.97 | 2.83 | | 4.4 | | |
| 1705208 | 4.2 | 2.83 | | | | | | | |
| 1711151 | 2.4 | | 3.05 | 2.48 | | | | | |
| 1732221 | | | | | | | | | −2.85 |
| 1756875 | | | | | | | 2.99 | | |
| 1786554 | | | | | 2.66 | | 2.67 | | |
| 1822716 | | | | | | | | | 2.45 |
| 1833362 | | | | | −3.7 | | −2.33 | | |
| 1834236 | | | | | −2.3 | | | | |
| 1838114 | −2.65 | | | | | | | | |
| 1845046 | −2.5 | | | | | | | | |
| 1846209 | | | 1.81 | | 2.2 | | | | |
| 1846463 | 3.62 | 6.58 | | | | | | | |
| 1861456 | | | | −2.51 | | | | | |
| 1867614 | | | | | | | | | 5.81 |
| 1869130 | | | | | | | | | −2.72 |
| 1871340 | | | | | | | | | −2.43 |
| 1874037 | | | | | | | | | 3.63 |

TABLE 1-continued

| Clone ID | Clofibrate | Fenofibrate | Captopril | Enalapril | Dexamethasone | DES | MCA | LY294002 | Ins/LY294002 |
|---|---|---|---|---|---|---|---|---|---|
| 1874307 | | | | | | | | | −2.57 |
| 1890576 | | | | | −2.5 | | −3.07 | | |
| 1890791 | 2.7 | | | | | | | | |
| 1920215 | −2.59 | | | | | | | | |
| 1922468 | 3.03 | | | | | | | | |
| 1926883 | 2.94 | | | | | | | | |
| 1930235 | 2.73 | | 3.25 | 3 | | | 2.93 | | |
| 1956982 | | | | | | −2.13 | | | |
| 1958226 | −2.52 | | | | | | | | |
| 1963081 | | | | | | | | | −4.16 |
| 1966517 | −2.8 | | | | | | | | |
| 1969563 | 3.78 | 6.8 | | | | | | | |
| 1975268 | | −2.42 | | −2.75 | −3.35 | | −2.51 | −3.45 | |
| 1998269 | 2.7 | 2.31 | 2.99 | 2.27 | 2.44 | | 2.46 | −2.46 | |
| 2042056 | 2.5 | 5.46 | | | | | | | −3.56 |
| 2046717 | | | | | 2.8 | | | | |
| 2048551 | | | | | 2.91 | | | | 5.55 |
| 2055569 | −2.76 | −3.12 | −3.33 | −3.1 | | | | | |
| 2055867 | | −3.4 | −2.61 | | | 2.97 | −2.67 | | |
| 2120743 | | | | | 3.25 | | 2.97 | | |
| 2121863 | | | | | | | | | 2.76 |
| 2123516 | 8.29 | 4.6 | 3.89 | 3.71 | 2.66 | | 3.83 | | |
| 2132285 | | | | | | | | | 2.94 |
| 2132774 | | | | | | | | | 2.7 |
| 2160794 | | | | | −2.51 | | | | |
| 2195427 | | | | | 2.3 | | 2.32 | | |
| 2201708 | | | | | | | | | 2.61 |
| 2208780 | | | | | | | | | −2.41 |
| 2232658 | | | | | | | 2.25 | | |
| 2234853 | | −2.7 | | | | | | | |
| 2241825 | | | | | | −2.39 | | | |
| 2242817 | | | | | | | | | 3.4 |
| 2252107 | | | | | | | 2.44 | | |
| 2273944 | 2.48 | | | | | | | | |
| 2278688 | −2.37 | | | | | | | | |
| 2293496 | | | | | | | −2.88 | | |
| 2311213 | | | | | | −2.34 | | | |
| 2343348 | | | | | 2.18 | | 2.89 | | |
| 2352645 | 3.77 | | | | | | | | |
| 2360580 | | −4.5 | −2.71 | | | | | | |
| 2365335 | −2.67 | | | | | | | | |
| 2382192 | −2.54 | | | | | | | | |
| 2382195 | | −2.87 | | | | | | | |
| 2383269 | | | | | | | | | −2.23 |
| 2394990 | | | | | | | | | −2.83 |
| 2399162 | | −2.5 | | | | | | | |
| 2446289 | | | −2.15 | | | | | | |
| 2448149 | | −2.35 | | | | | | | |
| 2453558 | | | | | | | | | −2.4 |
| 2470485 | −2.45 | | | | −2.8 | | | | |
| 2495131 | | | | | | | | | 2.22 |
| 2511277 | | | | | | | 3.07 | | |
| 2513883 | | 4.47 | | 3.82 | 3.93 | | 3.67 | | 17.42 |
| 2513883 | | | | | | | | | 3.35 |
| 2514988 | | | | | | | | | 4.03 |
| 2516448 | | | | | | | | | 2.88 |
| 2517254 | | | | | | | | | 2.65 |
| 2520894 | | | | | | | 3.21 | | |
| 2517386 | | | | | | | | | 2.51 |
| 2545486 | | | | | | −2.49 | | | |
| 2550767 | | | | | | 2.1 | | | |
| 2579218 | | | | | | | 2.42 | | |
| 2607921 | | −3.2 | | | | | | | |
| 2538878 | | | | | | | | | 2.31 |
| 2636043 | | | | | | | | | 4.58 |
| 2660756 | | | | | 2.21 | | 2.25 | | |
| 2675232 | | | | | | | 3.09 | | |
| 2695371 | | | | | | | 2.68 | | |
| 2708055 | | | | | | | 2.45 | | |
| 2740665 | −2.54 | | | | | | | | |
| 2756333 | | | | | | | 2.66 | | |
| 2757583 | 2.8 | 4.75 | 4.03 | 4.13 | 4.93 | | 4.31 | | 33.5 |
| 2765271 | | | | | | | 2.25 | | |
| 2769888 | −2.79 | −3.17 | −2.01 | | | | | −3.37 | |
| 2813255 | | | | | | | | | −2.72 |
| 2820337 | | | 2.29 | | | | | | |
| 2822027 | | | | | 3 | | 2.96 | | |

TABLE 1-continued

| Clone ID | Clofibrate | Fenofibrate | Captopril | Enalapril | Dexamethasone | DES | MCA | LY294002 | Ins/LY294002 |
|---|---|---|---|---|---|---|---|---|---|
| 2825358 | | | | | | | 2.44 | | |
| 2830828 | | | | | | | | | -3.15 |
| 2831490 | | | | | | | 2.48 | | |
| 2860918 | | | | | | | -3.2 | | |
| 2879068 | | | | | | | | | 2.67 |
| 2884613 | 2.54 | | 2.46 | 2.51 | | | 2.2 | | |
| 2890336 | -2.38 | | | | | | | | |
| 2891601 | | | | | | | 2.56 | | |
| 2899419 | | | | | | | | | 2.43 |
| 2912637 | | | -2.38 | | | | -4.29 | | |
| 2912830 | | | | | | | | | 3.8 |
| 2921194 | | | | | | | | | 3.4 |
| 2921991 | -3.1 | | -5.21 | -4.67 | -2.95 | | -3.43 | | |
| 2925373 | | | | | -2.63 | | | | |
| 2929484 | | -2.89 | | | | | | | |
| 2933775 | 4 | | 5.14 | 4.73 | 4.32 | | | | 6.47 |
| 2953987 | | | | | | | | | 3.13 |
| 2955163 | | | | 2.33 | | | 3.24 | | |
| 2956444 | | | | | | 2.1 | 3.04 | | |
| 2957205 | 2.94 | 2.44 | | | | | | | 2.35 |
| 2991027 | | | | | | | | | 2.9 |
| 2992044 | | | | | | | | | 3.07 |
| 2999855 | 2.4 | | | | | | | | |
| 3026540 | | | | | | | | | 2.65 |
| 3028719 | | | | | -2.6 | | | | |
| 3038508 | 2.57 | | | | | | | | |
| 3070625 | | | | | | | | | -2.67 |
| 3074113 | | | | | | | 3.03 | | |
| 3084204 | | | | | -2.47 | | | | |
| 3108506 | | | | | | | 3.02 | | |
| 3109384 | | | | | 2.6 | | | | |
| 3120209 | | | | | | | | | 2.53 |
| 3121380 | | | | | | | | | 3.32 |
| 3121871 | | | | | | | | | 7.45 |
| 3123731 | | | | | | | | | 3.07 |
| 3128810 | | | | | | | | | 4.34 |
| 3129338 | | | | | | | | | -2.86 |
| 3136857 | -3.24 | | | | | | | | |
| 3158828 | | | | | | | 2.67 | | |
| 3170010 | | | | | -3.67 | | | | |
| 3208425 | | | | | | | | | 2.54 |
| 3222802 | 2.71 | 2.55 | | | | 2.4 | 3.23 | | |
| 3225977 | | | 2.89 | | | | 2.59 | | |
| 3240708 | | | 2.02 | | | | | | |
| 3272165 | | -2.57 | | | | | | | |
| 3284411 | | | | | -2.4 | | | | |
| 3345528 | | | | | | | | | 4.11 |
| 3380034 | -3.15 | | | | | | | | |
| 3381870 | | | 2.62 | | | | 2.3 | | |
| 3407653 | | | | | | | 2.7 | | |
| 3427373 | | | | | | | | 4.2 | |
| 3472927 | | | | | | | 2.77 | | |
| 3493381 | | | | | | | 2.62 | | |
| 3493710 | | | | | | | | | 2.46 |
| 3494714 | -2.53 | | | | | | | | |
| 3606046 | | | | | | | 3.24 | | |
| 3679667 | | | -2.09 | | | | | | |
| 3715059 | | | | | -3.17 | | | -4.3 | |
| 3792988 | | | | | | | 3.23 | | |
| 3815422 | | | -3.78 | | | | | | |
| 4019706 | | | | | | 2.99 | 3.55 | | |
| 4066764 | -2.3 | | | | | | | | |
| 4070979 | | | | | | | 2.44 | | |
| 4087621 | -3.55 | | | | | | | | |
| 4091186 | | | | | 2.45 | | 2.64 | | |
| 4092112 | | | | | | | 3.55 | | |
| 4107126 | | | 2.88 | | | | | | |
| 4110976 | 2.18 | | | | | | | | |
| 4203937 | | | | | | | 7.13 | | |
| 4246966 | 8.12 | | | | | | 3.03 | | |
| 4254855 | | | | | | | 2.3 | | |
| 4284384 | | | | | | | 2.73 | | |
| 4287327 | -3.47 | -3.14 | | | | 2.66 | -2.54 | | -2.14 |
| 4403805 | | | | | | | 2.4 | | |
| 4508879 | | | | | 2.86 | | 2.68 | | |
| 4549259 | | | | | | | 2.53 | | |
| 4556538 | | 2.53 | | 3.02 | | | | 2.45 | |

TABLE 1-continued

| Clone ID | Clofibrate | Fenofibrate | Captopril | Enalapril | Dexamethasone | DES | MCA | LY294002 | Ins/LY294002 |
|---|---|---|---|---|---|---|---|---|---|
| 4715924 | | | | | | -2.21 | | | |
| 4721130 | 4.25 | | | | | | 3.57 | | |
| 4795635 | -2.38 | | | | | | | | |
| 5047895 | -2.44 | | | | | | | | |
| 5077219 | -2.63 | | | | | | | | |
| 5093071 | | | | | | | 2.36 | | |
| 5102731 | | | | | | | 2.33 | | |
| 5266015 | | | | | | | 2.47 | | |
| 5266376 | | | | | | | 2.54 | | |
| 5293028 | | | | | | -2.3 | | | |
| 5398014 | -2.67 | | | | | | | | |
| 5398701 | -3.55 | | | | | | | | |
| 5399371 | | | | | 2.63 | -2.63 | | | |
| 5512044 | | | | | | | 2.26 | | |
| 5541949 | 2.38 | | | | | | | | |

TABLE 2

| CLONE ID | NUCLEOIDE SEQ ID NO: | NUCLEOTIDE TEMPLATE ID | PROTEIN SEQ ID NO: | PROTEIN TEMPLATE ID |
|---|---|---|---|---|
| 26474 | 1 | 220060.4 | | |
| 60123 | 2 | 016238.1 | | |
| 63038 | 3 | 1266683.1 | | |
| 72713 | 4 | 129384.1c | | |
| 85606 | 5 | 3201389CB1 | 6 | 3201389CD1 |
| 86390 | 7 | 086390CB1 | 8 | 086390CD1 |
| 118501 | 9 | 1102322.16 | | |
| 118501 | 10 | 1545176CB1 | 11 | 1545176CD1 |
| 121785 | 12 | 978222.4 | | |
| 121785 | 13 | 978222.5 | | |
| 136073 | 14 | 1720920CB1 | 15 | 1720920CD1 |
| 160822 | 16 | 1857017CB1 | 17 | 1857017CD1 |
| 3493710 | 16 | 1857017CB1 | 17 | 1857017CD1 |
| 167081 | 18 | 2114865CB1 | 19 | 2114865CD1 |
| 172023 | 20 | 2700132CB1 | 21 | 2700132CD1 |
| 2470485 | 20 | 2700132CB1 | 21 | 2700132CD1 |
| 211389 | 22 | 238349.2 | | |
| 211389 | 23 | 238349.4c | | |
| 237027 | 24 | 402917.3c | | |
| 259054 | 25 | 406330.1 | | |
| 271299 | 26 | 2516070CB1 | 27 | 2516070CD1 |
| 2517386 | 26 | 2516070CB1 | 27 | 2516070CD1 |
| 279249 | 28 | 167507CB1 | 29 | 167507CD1 |
| 279898 | 30 | 3860413CB1 | 31 | 3860413CD1 |
| 3121871 | 30 | 3860413CB1 | 31 | 3860413CD1 |
| 280932 | 32 | 3393861CB1 | 33 | 3393861CD1 |
| 293477 | 34 | 2517374CB1 | 35 | 2517374CD1 |
| 311346 | 36 | 030850.7 | | |
| 318486 | 37 | 237416.12c | | |
| 318486 | 38 | 237416.14 | | |
| 341884 | 39 | 1269631CB1 | 40 | 1269631CD1 |
| 348143 | 41 | 961189CB1 | 42 | 961189CD1 |
| 388964 | 43 | 246946.1 | | |
| 389362 | 44 | 017958.1 | | |
| 407032 | 45 | 985556.1 | | |
| 408886 | 46 | 476301CB1 | 47 | 476301CD1 |
| 419492 | 48 | 996427.2 | | |
| 437481 | 49 | 2989375CB1 | 50 | 2989375CD1 |
| 442723 | 51 | 236359.2 | | |
| 443991 | 52 | 011112.1c | | |
| 450856 | 53 | 198268.1 | | |
| 452321 | 54 | 978740.3 | | |
| 454839 | 55 | 400197.1 | | |
| 459372 | 56 | 235687.5c | | |
| 460779 | 57 | 2797839CB1 | 58 | 2797839CD1 |
| 462069 | 59 | 978690.6 | | |
| 480791 | 60 | 348072.5 | | |
| 481402 | 61 | 085596CB1 | 62 | 085596CD1 |
| 510056 | 63 | 103917CB1 | 64 | 103917CD1 |
| 511448 | 65 | 3603037CB1 | 66 | 3603037CD1 |
| 560115 | 67 | 088564CB1 | 68 | 088564CD1 |
| 604019 | 69 | 040429.1 | | |
| 630625 | 70 | 407096.2 | | |
| 669498 | 71 | 209265.54 | | |
| 701484 | 72 | 701484CB1 | 73 | 701484CD1 |
| 758192 | 74 | 251859.2 | | |
| 773154 | 75 | 3766715CB1 | 76 | 3766715CD1 |
| 818192 | 77 | 2049950CB1 | 78 | 2049950CD1 |
| 818192 | 79 | 231588.6c | | |
| 872017 | 80 | 152298.2 | | |
| 891322 | 81 | 199507.1 | | |
| 963536 | 82 | 1434821CB1 | 83 | 1434821CD1 |
| 970905 | 84 | 289671.27 | | |
| 990375 | 85 | 1282225CB1 | 86 | 1282225CD1 |
| 1213932 | 87 | 263336.57 | | |
| 1259841 | 88 | 464689.40 | | |
| 1272483 | 89 | 155943.1 | | |
| 1306814 | 90 | 243794.19c | | |
| 1306814 | 91 | 243794.23 | | |
| 1308112 | 92 | 159309CB1 | 93 | 159309CD1 |
| 1315663 | 94 | 1273641CB1 | 95 | 1273641CD1 |
| 1316801 | 96 | 403717.1 | | |
| 1326255 | 97 | 047593.1 | | |
| 1368834 | 98 | 347055.4 | | |
| 1379063 | 99 | 898899.11 | | |
| 1379063 | 100 | 898899.32 | | |
| 1381654 | 101 | 2047630CB1 | 102 | 2047630CD1 |
| 1395143 | 103 | 1039889.8 | | |
| 1435374 | 104 | 1272969CB1 | 105 | 1272969CD1 |
| 1441245 | 106 | 282397.85c | | |
| 1441245 | 107 | 282397.94 | | |
| 1448718 | 108 | 1448817CB1 | 109 | 1448817CD1 |
| 1454436 | 110 | 1100769.2 | | |
| 1457424 | 111 | 332521.1 | | |
| 1457718 | 112 | 225080.16 | | |
| 1464613 | 113 | 334851.5 | | |
| 1468660 | 114 | 995529.7 | | |
| 1468660 | 115 | 995529.8 | | |
| 1482116 | 116 | 201851.1 | | |
| 1495382 | 117 | 059509CB1 | 118 | 059509CD1 |
| 1500245 | 119 | 481231.14 | | |
| 1511658 | 120 | 280276CB1 | 121 | 280276CD1 |
| 1519431 | 122 | 4675668CB1 | 123 | 4675668CD1 |
| 1519683 | 124 | 153825.1 | | |
| 1522880 | 125 | 403484.2c | | |
| 1522880 | 126 | 1459432CB1 | 127 | 1459432CD1 |
| 1530595 | 128 | 1096583.1 | | |
| 1559665 | 129 | 516300CB1 | 130 | 516300CD1 |
| 1559756 | 131 | 627856CB1 | 132 | 627856CD1 |
| 1560906 | 133 | 1823159CB1 | 134 | 1823159CD1 |
| 1577614 | 135 | 232567.4 | | |
| 1616783 | 136 | 218419.1 | | |

TABLE 2-continued

| CLONE ID | NUCLEOIDE SEQ ID NO: | NUCLEOTIDE TEMPLATE ID | PROTEIN SEQ ID NO: | PROTEIN TEMPLATE ID |
|---|---|---|---|---|
| 1619292 | 137 | 1630551CB1 | 138 | 1630551CD1 |
| 1619980 | 139 | 360961.19 | | |
| 1623214 | 140 | 809809CB1 | 141 | 809809CD1 |
| 1630990 | 142 | 2558815CB1 | 143 | 2558815CD1 |
| 1696224 | 144 | 242010.16 | | |
| 1696224 | 145 | 1678695CB1 | 146 | 1678695CD1 |
| 1705208 | 147 | 988653.1 | | |
| 1711151 | 148 | 1250434CB1 | 149 | 1250434CD1 |
| 1732221 | 150 | 236196.3 | | |
| 1756875 | 151 | 442308.1 | | |
| 1786554 | 152 | 060957.1 | | |
| 1822716 | 153 | 014284CB1 | 154 | 014284CD1 |
| 1833362 | 155 | 1095192.1 | | |
| 1834236 | 156 | 233003.20 | | |
| 1834236 | 157 | 1911808CB1 | 158 | 1911808CD1 |
| 1838114 | 159 | 978276.8 | | |
| 1845046 | 160 | 405844.21 | | |
| 1845046 | 161 | 405844.22 | | |
| 1846209 | 162 | 2705515CB1 | 163 | 2705515CD1 |
| 1846463 | 164 | 2023119CB1 | 165 | 2023119CD1 |
| 1861456 | 166 | 1000084.27 | | |
| 3679667 | 166 | 1000084.27 | | |
| 1867614 | 167 | 220134.1 | | |
| 1869130 | 168 | 216331.1 | | |
| 1871340 | 169 | 206044.1 | | |
| 1874037 | 170 | 382906.16 | | |
| 1874307 | 171 | 331306.1 | | |
| 1890576 | 172 | 1094829.20 | | |
| 1890576 | 173 | 1094829.38 | | |
| 1890791 | 174 | 1135580.4 | | |
| 1920215 | 175 | 196623.3 | | |
| 1922468 | 176 | 048488.32 | | |
| 1926883 | 177 | 2767012CB1 | 178 | 2767012CD1 |
| 1930235 | 179 | 1651724CB1 | 180 | 1651724CD1 |
| 1956982 | 181 | 206397.1 | | |
| 1958226 | 182 | 461707.40 | | |
| 1963081 | 183 | 2706645CB1 | 184 | 2706645CD1 |
| 1966517 | 185 | 474372.7 | | |
| 1969563 | 186 | 3592543CB1 | 187 | 3592543CD1 |
| 1975268 | 188 | 048612.12c | | |
| 1975268 | 189 | 048612.13 | | |
| 1998269 | 190 | 245259.16 | | |
| 2042056 | 191 | 522433CB1 | 192 | 522433CD1 |
| 2046717 | 193 | 1040667.43 | | |
| 2048551 | 194 | 2048551CB1 | 195 | 2048551CD1 |
| 2055569 | 196 | 1969731CB1 | 197 | 1969731CD1 |
| 2055867 | 198 | 1326983.14 | | |
| 2120743 | 199 | 2120743CB1 | 200 | 2120743CD1 |
| 2121863 | 201 | 3551330CB1 | 202 | 3551330CD1 |
| 2123516 | 203 | 1440032CB1 | 204 | 1440032CD1 |
| 2132285 | 205 | 1000133.1 | | |
| 2132774 | 206 | 4020439CB1 | 207 | 4020439CD1 |
| 2160794 | 208 | 2507087CB1 | 209 | 2507087CD1 |
| 2195427 | 210 | 239996.1 | | |
| 2201708 | 211 | 1097380.1 | | |
| 2208780 | 212 | 021524.2c | | |
| 2208780 | 213 | 021524.9 | | |
| 2232658 | 214 | 253987.16 | | |
| 2234853 | 215 | 344553.1 | | |
| 2241825 | 216 | 410785.1 | | |
| 2242817 | 217 | 237623.6 | | |
| 2252107 | 218 | 076047.1 | | |
| 2273944 | 219 | 1099500.15 | | |
| 2273944 | 220 | 1099500.18 | | |
| 2278688 | 221 | 2278688CB1 | 222 | 2278688CD1 |
| 2293496 | 223 | 380283.1 | | |
| 2311213 | 224 | 1720847CB1 | 225 | 1720847CD1 |
| 2343348 | 226 | 333776.1c | | |
| 2352645 | 227 | 3478236CB1 | 228 | 3478236CD1 |
| 2360580 | 229 | 147541.17 | | |
| 2365335 | 230 | 331120.16c | | |
| 2382192 | 231 | 575983CB1 | 232 | 575983CD1 |
| 2382195 | 233 | 413268.6 | | |
| 2383269 | 234 | 1989186CB1 | 235 | 1989186CD1 |
| 2394990 | 236 | 337448.1c | | |
| 2399162 | 237 | 228304.19 | | |
| 2446289 | 238 | 420527.25 | | |
| 2448149 | 239 | 998034.3 | | |
| 2453558 | 240 | 474165.26 | | |
| 2495131 | 241 | 697785CB1 | 242 | 697785CD1 |
| 2511277 | 243 | 346209.3 | | |
| 2513883 | 244 | 167772CB1 | 245 | 167772CD1 |
| 2514988 | 246 | 2514988CB1 | 247 | 2514988CD1 |
| 2516070 | 248 | 481231.16 | | |
| 2516070 | 249 | 481231.17 | | |
| 2516104 | 249 | 481231.17 | | |
| 2516261 | 249 | 481231.17 | | |
| 2516448 | 249 | 481231.17 | | |
| 2517254 | 250 | 1045853.2 | | |
| 5398014 | 250 | 1045853.2 | | |
| 2520894 | 251 | 336615.1 | | |
| 2527879 | 252 | 1328423.2 | | |
| 2545486 | 253 | 085282.1 | | |
| 2550767 | 254 | 1081605.3 | | |
| 2579218 | 255 | 1053517.1 | | |
| 2607921 | 256 | 480169.76 | | |
| 2636043 | 257 | 2636043CB1 | 258 | 2636043CD1 |
| 2641522 | 259 | 2993696CB1 | 260 | 2993696CD1 |
| 2660756 | 261 | 240518.21 | | |
| 2660756 | 262 | 240518.34 | | |
| 2663164 | 263 | 001322.4c | | |
| 2675232 | 264 | 350502.3 | | |
| 2675232 | 265 | 350502.4c | | |
| 2695371 | 266 | 253783.3 | | |
| 2708055 | 267 | 085119.1 | | |
| 2740665 | 268 | 902559.1 | | |
| 2756333 | 269 | 4113161CB1 | 270 | 4113161CD1 |
| 2757583 | 271 | 2757583CB1 | 272 | 2757583CD1 |
| 2765271 | 273 | 198317.1 | | |
| 2769888 | 274 | 1508254CB1 | 275 | 1508254CD1 |
| 2813255 | 276 | 474691.3 | | |
| 2820337 | 277 | 2457215CB1 | 278 | 2457215CD1 |
| 2822027 | 279 | 201395.4c | | |
| 2825358 | 280 | 233189.21 | | |
| 2830828 | 281 | 196606.6c | | |
| 2830828 | 282 | 196606.8c | | |
| 2831490 | 283 | 1040190.3 | | |
| 2860918 | 284 | 1427459CB1 | 285 | 1427459CD1 |
| 2879068 | 286 | 480453.16c | | |
| 2884613 | 287 | 1095604.1 | | |
| 2890336 | 288 | 241291.28 | | |
| 2891601 | 289 | 230611.1 | | |
| 2899419 | 290 | 3993708CB1 | 291 | 3993708CD1 |
| 2899419 | 292 | 1000133.12 | | |
| 2912637 | 293 | 400253.17c | | |
| 2912637 | 294 | 400253.5 | | |
| 2912830 | 295 | 030882CB1 | 296 | 030882CD1 |
| 2921194 | 297 | 898779CB1 | 298 | 898779CD1 |
| 2921991 | 299 | 3727408CB1 | 300 | 3727408CD1 |
| 2925373 | 301 | 984236.1c | | |
| 2925373 | 302 | 984236.2c | | |
| 2929484 | 303 | 348082.5 | | |
| 2929484 | 304 | 348082.7 | | |
| 2933775 | 305 | 1097910.1 | | |
| 2953987 | 306 | 246841.1 | | |
| 2955163 | 307 | 351241.1 | | |
| 2956444 | 308 | 2790762CB1 | 309 | 2790762CD1 |
| 2957205 | 310 | 2253717CB1 | 311 | 2253717CD1 |
| 2991027 | 312 | 2655184CB1 | 313 | 2655184CD1 |
| 2991027 | 314 | 363000.9c | | |
| 2992044 | 315 | 232818.15 | | |
| 2999855 | 316 | 347781.10 | | |
| 2999855 | 317 | 2477616CB1 | 318 | 2477616CD1 |
| 3026540 | 319 | 360532.1 | | |
| 3026540 | 320 | 360532.9 | | |
| 3028719 | 321 | 110245.1 | | |
| 3038508 | 322 | 478620.53 | | |
| 3038508 | 323 | 1813444CB1 | 324 | 1813444CD1 |
| 3070625 | 325 | 474588.21 | | |
| 3074113 | 326 | 407838.1 | | |

TABLE 2-continued

| CLONE ID | NUCLEOIDE SEQ ID NO: | NUCLEOTIDE TEMPLATE ID | PROTEIN SEQ ID NO: | PROTEIN TEMPLATE ID |
|---|---|---|---|---|
| 3084204 | 327 | 994387.19 | | |
| 3108506 | 328 | 347796.7 | | |
| 3109384 | 329 | 406498.4c | | |
| 3120209 | 330 | 3346307CB1 | 331 | 3346307CD1 |
| 3121380 | 332 | 4005778CB1 | 333 | 4005778CD1 |
| 3123731 | 334 | 995575.17 | | |
| 3128810 | 335 | 863406CB1 | 336 | 863406CD1 |
| 3129338 | 337 | 413864.17 | | |
| 3136857 | 338 | 350106.16 | | |
| 3158828 | 339 | 399785.1 | | |
| 3170010 | 340 | 010498.19 | | |
| 3208425 | 341 | 255824.39 | | |
| 3208425 | 342 | 2706606CB1 | 343 | 2706606CD1 |
| 3222802 | 344 | 118006.1 | | |
| 3225977 | 345 | 1039889.26 | | |
| 3240708 | 346 | 481480.7 | | |
| 3272165 | 347 | 662575CB1 | 348 | 662575CD1 |
| 3284411 | 349 | 027619.3 | | |
| 3345528 | 350 | 235447.5 | | |
| 3380034 | 351 | 331104.2 | | |
| 3381870 | 352 | 348390.2 | | |
| 3407653 | 353 | 127004.1 | | |
| 3427373 | 354 | 026190.1 | | |
| 3472927 | 355 | 250330.1 | | |
| 3493381 | 356 | 480375.28 | | |
| 3494714 | 357 | 364726.10 | | |
| 3494714 | 358 | 364726.12 | | |
| 3606046 | 359 | 1505038CB1 | 360 | 1505038CD1 |
| 3715059 | 361 | 903508.12 | | |
| 3792988 | 362 | 346716.17c | | |
| 3792988 | 363 | 346716.21c | | |
| 3815422 | 364 | 330776.1 | | |
| 4019706 | 365 | 407999.1c | | |
| 4066764 | 366 | 1719478CB1 | 367 | 1719478CD1 |
| 4070979 | 368 | 351157.2 | | |
| 4087621 | 369 | 088957CB1 | 370 | 088957CD1 |
| 5398701 | 369 | 088957CB1 | 370 | 088957CD1 |
| 4091186 | 371 | 980446.1 | | |
| 4092112 | 372 | 198827.1 | | |
| 4107126 | 373 | 1102297.22 | | |
| 4110976 | 374 | 215112.1 | | |
| 4203937 | 375 | 171495.1 | | |
| 4246966 | 376 | 242010.43 | | |
| 4254855 | 377 | 5834958CB1 | 378 | 5834958CD1 |
| 4284384 | 379 | 335648.1c | | |
| 4287327 | 380 | 333840.1 | | |
| 4403805 | 381 | 480885.2 | | |
| 4508879 | 382 | 998106.8c | | |
| 4549259 | 383 | 400701.4 | | |
| 4556538 | 384 | 1100320.4 | | |
| 4715924 | 385 | 246727.11 | | |
| 4715924 | 386 | 246727.17 | | |
| 4721130 | 387 | 1102322.12c | | |
| 4721130 | 388 | 1102322.18 | | |
| 4795635 | 389 | 2070610CB1 | 390 | 2070610CD1 |
| 5047895 | 391 | 336733.3 | | |
| 5077219 | 392 | 1326902.13 | | |
| 5077219 | 393 | 1326902.6 | | |
| 5093071 | 394 | 013521.16 | | |
| 5102731 | 395 | 985369.1 | | |
| 5266015 | 396 | 002455.1 | | |
| 5266376 | 397 | 372647.1 | | |
| 5293028 | 398 | 208075.1 | | |
| 5399371 | 399 | 209279.1 | | |
| 5512044 | 400 | 381058.1 | | |
| 5541949 | 401 | 046977.1 | | |

TABLE 3

| SEQ ID NO: | TEMPLATE ID | GI Number | E-value | Annotation |
|---|---|---|---|---|
| 1 | 220060.4 | g847737 | 0 | Human transthyretin precursor mRNA, complete cds. |
| 2 | 016238.1 | g187326 | 0 | Human macrophage mannose receptor (MRC1) gene, exon 24. |
| 3 | 1266683.1 | g1103903 | 0 | Human spermidine/spermine N1-acetyltransferase (SSAT) gene, complete cds. |
| 4 | 129384.1c | g508989 | 0 | Human (oct-6) mRNA, complete cds. |
| 5 | 3201389CB1 | g927210 | 0 | Human mRNA for adrenergic receptor alpha 1C isoform 3, complete cds. |
| 6 | 3201389CD1 | g927210 | 0 | Human mRNA for adrenergic receptor alpha 1C isoform 3, complete cds. |
| 7 | 086390CB1 | g337749 | 0 | Human serum amyloid A protein mRNA, complete cds. |
| 8 | 086390CD1 | g337749 | 0 | Human serum amyloid A protein mRNA, complete cds. |
| 9 | 1102322.16 | g313283 | 0 | African green monkey hsp70 mRNA. |
| 10 | 1545176CB1 | g313283 | 0 | African green monkey hsp70 mRNA. |
| 11 | 1545176CD1 | g313283 | 0 | African green monkey hsp70 mRNA. |
| 12 | 978222.4 | g6006501 | 0 | Human mRNA for basic-helix-loop-helix protein, bHLH (Hey2 gene). |
| 13 | 978222.5 | g6006501 | 0 | Human mRNA for basic-helix-loop-helix protein, bHLH (Hey2 gene). |
| 14 | 1720920CB1 | g1617313 | 0 | Human mRNA for melanoma-associated chondroitin sulfate proteoglycan (MCSP). |
| 15 | 1720920CD1 | g1617313 | 0 | Human mRNA for melanoma-associated chondroitin sulfate proteoglycan (MCSP). |
| 16 | 1857017CB1 | g184243 | 0 | Human 3-hydroxy-3-methylglutaryl CoA reductase mRNA, complete cds. |
| 17 | 1857017CD1 | g184243 | 0 | Human 3-hydroxy-3-methylglutaryl CoA reductase mRNA, complete cds. |
| 18 | 2114865CB1 | g177808 | 0 | Human alpha-1-antichymotrypsin (AACT) mRNA, complete cds. |
| 19 | 2114865CD1 | g177808 | 0 | Human alpha-1-antichymotrypsin (AACT) mRNA, complete cds. |
| 20 | 2700132CB1 | g415818 | 0 | Human mki67a mRNA (long type) for antigen of monoclonal antibody Ki-67. |
| 21 | 2700132CD1 | g415818 | 0 | Human mki67a mRNA (long type) for antigen of monoclonal antibody Ki-67. |

TABLE 3-continued

| SEQ ID NO: | TEMPLATE ID | GI Number | E-value | Annotation |
|---|---|---|---|---|
| 22 | 238349.2 | g4324682 | E–104 | late gestation lung protein 1 [Rattus norvegicus] |
| 23 | 238349.4c | g7644416 | 0.4 | Mus platythrix TSPY gene, intron 1. |
| 24 | 402917.3c | | | Incyte Unique |
| 25 | 406330.1 | g182103 | 0 | Human enkephalin B (enkB) gene, exon 4 and 3' flank and complete cds. |
| 26 | 2516070CB1 | g28771 | 0 | Human mRNA for apolipoprotein AI (apo AI)=. |
| 27 | 2516070CD1 | g28771 | 0 | Human mRNA for apolipoprotein AI (apo AI)=. |
| 28 | 167507CB1 | g177889 | 0 | Human alpha-2-thiol protease inhibitor mRNA, complete coding sequence. |
| 29 | 167507CD1 | g177889 | 0 | Human alpha-2-thiol protease inhibitor mRNA, complete coding sequence. |
| 30 | 3860413CB1 | g187530 | 0 | Human metallothionein-II pseudogene (mt-IIps). |
| 31 | 3860413CD1 | g187530 | 0 | Human metallothionein-II pseudogene (mt-IIps). |
| 32 | 3393861CB1 | g182429 | 0 | Human fibrinogen beta-chain mRNA, partial cds. |
| 33 | 3393861CD1 | g182429 | 0 | Human fibrinogen beta-chain mRNA, partial cds. |
| 34 | 2517374CB1 | g24444 | 0 | Human mRNA for alpha1-acid glycoprotein (orosomucoid). |
| 35 | 2517374CD1 | g24444 | 0 | Human mRNA for alpha1-acid glycoprotein (orosomucoid). |
| 36 | 030850.7 | | | Incyte Unique |
| 37 | 237416.12c | g396704 | 5.00E–92 | Human integrin associated protein mRNA, complete cds,. |
| 38 | 237416.14 | g396704 | 0 | Human integrin associated protein mRNA, complete cds,. |
| 39 | 1269631CB1 | g5030423 | 0 | Human gp250 precursor, mRNA, complete cds. |
| 40 | 1269631CD1 | g5030423 | 0 | Human gp250 precursor, mRNA, complete cds. |
| 41 | 961189CB1 | g286008 | 0 | Human mRNA for KIAA0020 gene, complete cds. |
| 42 | 961189CD1 | g286008 | 0 | Human mRNA for KIAA0020 gene, complete cds. |
| 43 | 246946.1 | g4107230 | 3.00E–34 | Human mRNA for lipophilin B. |
| 44 | 017958.1 | | | Incyte Unique |
| 45 | 985556.1 | | | Incyte Unique |
| 46 | 476301CB1 | g1232174 | 0 | Human mRNA for transketolase-like protein (2418 bp). |
| 47 | 476301CD1 | g1232174 | 0 | Human mRNA for transketolase-like protein (2418 bp). |
| 48 | 996427.2 | g179892 | 0 | Human cAMP phosphodiesterase PDE7 (PDE7A1) mRNA, complete cds. |
| 49 | 2989375CB1 | | | Incyte Unique |
| 50 | 2989375CD1 | | | Incyte Unique |
| 51 | 236359.2 | | | Incyte Unique |
| 52 | 011112.1c | g3183903 | 0 | Human partial mRNA; ID YG40-1B. |
| 53 | 198268.1 | g4337095 | 0 | Human MSH55 gene, partial cds; and CLIC1, DDAH, G6b, G6c, G5b, G6d, G6e, G6f, BAT5, G5b, CSK: |
| 54 | 978740.3 | | | Incyte Unique |
| 55 | 400197.1 | g1457944 | 5.00E–10 | Human desmoglein 3 gene, promoter region. |
| 56 | 235687.5c | | | Incyte Unique |
| 57 | 2797839CB1 | g189421 | 0 | Human proliferating-cell nucleolar protein P120 mRNA, complete cds. |
| 58 | 2797839CD1 | g189421 | 0 | Human proliferating-cell nucleolar protein P120 mRNA, complete cds. |
| 59 | 978690.6 | g3287264 | e–145 | Rattus norvegicus mRNA for STOP protein. |
| 60 | 348072.5 | g288562 | 0 | Human mRNA for inter-alpha-trypsin inhibitor heavy chain H3. |
| 61 | 085596CB1 | g184391 | 0 | Human histidine-rich glycoprotein mRNA, complete cds. |
| 62 | 085596CD1 | g184391 | 0 | Human histidine-rich glycoprotein mRNA, complete cds. |
| 63 | 103917CB1 | g183030 | 0 | Human grancalcin mRNA, complete cds. |
| 64 | 103917CD1 | g183030 | 0 | Human grancalcin mRNA, complete cds. |
| 65 | 3603037CB1 | g181986 | 0 | Human early growth response 2 protein (EGR2) mRNA, complete cds. |
| 66 | 3603037CD1 | g181986 | 0 | Human early growth response 2 protein (EGR2) mRNA, complete cds. |
| 67 | 088564CB1 | g1778716 | 0 | Human chemokine exodus-1 mRNA, complete cds. |
| 68 | 088564CD1 | g1778716 | 0 | Human chemokine exodus-1 mRNA, complete cds. |
| 69 | 040429.1 | | | Incyte Unique |
| 70 | 407096.2 | g1237037 | 0 | Human mRNA for thioredoxin reductase. |
| 71 | 209265.54 | g2160718 | 0 | Human amphiphysin II mRNA, complete cds. |
| 72 | 701484CB1 | g5926690 | 0 | Human genomic DNA, chromosome 6p21.3, HLA Class I region, section 2/20. |
| 73 | 701484CD1 | g5926690 | 0 | Human genomic DNA, chromosome 6p21.3, HLA Class I region, section 2/20. |
| 74 | 251859.2 | g1145815 | 0 | Human 54 kDa progesterone receptor-associated immunophilin FKBP54 mRNA, partial cds. |
| 75 | 3766715CB1 | g4914599 | 0 | Human mRNA; cDNA DKFZp564A126 (from clone DKFZp564A126); partial cds. |
| 76 | 3766715CD1 | g4914599 | 0 | Human mRNA; cDNA DKFZp564A126 (from clone DKFZp564A126); partial cds. |
| 77 | 2049950CB1 | g183038 | 0 | Human gamma-glutamylcysteine synthetase (GCS) mRNA, complete cds. |
| 78 | 2049950CD1 | g183038 | 0 | Human gamma-glutamylcysteine synthetase (GCS) mRNA, complete cds. |
| 79 | 231588.6c | g183038 | 0 | Human gamma-glutamylcysteine synthetase (GCS) mRNA, complete cds. |
| 80 | 152298.2 | | | Incyte Unique |
| 81 | 199507.1 | | | Incyte Unique |
| 82 | 1434821CB1 | g35706 | 0 | Human pS2 mRNA induced by estrogen from Human breast cancer cell line MCF-7. |
| 83 | 1434821CD1 | g35706 | 0 | Human pS2 mRNA induced by estrogen from Human breast cancer cell line MCF-7. |
| 84 | 289671.27 | g31896 | 0 | Human GPx-3 mRNA for plasma glutathione peroxidase. |
| 85 | 1282225CB1 | g182355 | 0 | Human liver fatty acid binding protein (FABP) mRNA, complete cds. |
| 86 | 1282225CD1 | g182355 | 0 | Human liver fatty acid binding protein (FABP) mRNA, complete cds. |
| 87 | 263336.57 | g187538 | 0 | Human metallothionein-Ie gene (hMT-Ie). |
| 88 | 464689.40 | g30257 | 0 | Human CST3 gene for cystatin C. |
| 89 | 155943.1 | g6453599 | 0 | Human mRNA; cDNA DKFZp434K098 (from clone DKFZp434K098); partial cds. |
| 90 | 243794.19c | g550026 | 0 | Human ribosomal protein S29 mRNA, complete cds. |

TABLE 3-continued

| SEQ ID NO: | TEMPLATE ID | GI Number | E-value | Annotation |
|---|---|---|---|---|
| 91 | 243794.23 | g550026 | 0 | Human ribosomal protein S29 mRNA, complete cds. |
| 92 | 159309CB1 | g510689 | 0 | Human Ki nuclear autoantigen mRNA, complete cds. |
| 93 | 159309CD1 | g510689 | 0 | Human Ki nuclear autoantigen mRNA, complete cds. |
| 94 | 1273641CB1 | | | Incyte Unique |
| 95 | 1273641CD1 | | | Incyte Unique |
| 96 | 403717.1 | | | Incyte Unique |
| 97 | 047593.1 | | | Incyte Unique |
| 98 | 347055.4 | g410027 | 0 | Human 3-hydroxy-3-methylglutaryl CoA synthase mRNA, complete cds. |
| 99 | 898899.11 | g183976 | 0 | Human hepatocyte growth factor-like protein mRNA, complete cds. |
| 100 | 898899.32 | g1311660 | 0 | Human hepatocyte growth factor-like protein gene, complete cds. |
| 101 | 2047630CB1 | g179099 | 0 | Human asparagine synthetase mRNA, complete cds. |
| 102 | 2047630CD1 | g179099 | 0 | Human asparagine synthetase mRNA, complete cds. |
| 103 | 1039889.8 | g178042 | 0 | Human cytoskeletal gamma-actin gene, complete cds. |
| 104 | 1272969CB1 | g286028 | 0 | Human mRNA for XPAC protein. |
| 105 | 1272969CD1 | g286028 | 0 | Human mRNA for XPAC protein. |
| 106 | 282397.85c | g3660662 | 0 | Human D15F37 pseudogene, S3 allele, mRNA sequence. |
| 107 | 282397.94 | g6683696 | 0 | Human mRNA for KIAA0393 protein, partial cds. |
| 108 | 1448817CB1 | g183117 | 0 | Human insulin-like growth factor binding protein mRNA, complete cds. |
| 109 | 1448817CD1 | g183117 | 0 | Human insulin-like growth factor binding protein mRNA, complete cds. |
| 110 | 1100769.2 | g296451 | 0 | Human mRNA for ribosomal protein S26. |
| 111 | 332521.1 | | | Incyte Unique |
| 112 | 225080.16 | g951313 | 0 | Human 2,3-oxidosqualene-lanosterol cyclase mRNA, complete cds. |
| 113 | 334851.5 | g5912050 | 0 | Human mRNA; cDNA DKFZp434P1550 (from clone DKFZp434P1550); partial cds. |
| 114 | 995529.7 | g3126638 | 0 | Human mRNA for CDC2 delta T, complete cds. |
| 115 | 995529.8 | g29838 | 0 | Human CDC2 gene involved in cell cycle control. |
| 116 | 201851.1 | g2104768 | 0 | Human echinoderm microtubule-associated protein homolog HuEMAP mRNA, complete cds. |
| 117 | 059509CB1 | g1149557 | 0 | Human TNF-related apoptosis inducing ligand TRAIL mRNA, complete cds. |
| 118 | 059509CD1 | g1149557 | 0 | Human TNF-related apoptosis inducing ligand TRAIL mRNA, complete cds. |
| 119 | 481231.14 | g28771 | 0 | Human mRNA for apolipoprotein AI (apo AI)=. |
| 120 | 280276CB1 | g182406 | 0 | Human fibrinogen alpha subunit and fibrinogen alpha subunit precursor, genes, complete cds. |
| 121 | 280276CD1 | g182406 | 0 | Human fibrinogen alpha subunit and fibrinogen alpha subunit precursor, genes, complete cds. |
| 122 | 4675668CB1 | g1160618 | 0 | Human bystin mRNA, complete cds. |
| 123 | 4675668CD1 | g1160618 | 0 | Human bystin mRNA, complete cds. |
| 124 | 153825.1 | g456256 | 0 | Human stromelysin-3 mRNA. |
| 125 | 403484.2c | g1737178 | 0 | Human somatostatin receptor-like protein (GPR24) gene, complete cds. |
| 126 | 1459432CB1 | g1737178 | 0 | Human somatostatin receptor-like protein (GPR24) gene, complete cds. |
| 127 | 1459432CD1 | g1737178 | 0 | Human somatostatin receptor-like protein (GPR24) gene, complete cds. |
| 128 | 1096583.1 | g30340 | 9.00E−96 | Human gene for cytochrome P(1)-450. |
| 129 | 516300CB1 | g1098616 | 0 | Human CD94 protein mRNA, complete cds. |
| 130 | 516300CD1 | g1098616 | 0 | Human CD94 protein mRNA, complete cds. |
| 131 | 627856CB1 | g2665518 | 0 | Human tyrosyl-tRNA synthetase mRNA, complete cds. |
| 132 | 627856CD1 | g2665518 | 0 | Human tyrosyl-tRNA synthetase mRNA, complete cds. |
| 133 | 1823159CB1 | g1378039 | 0 | Human myotubularin (MTM1) mRNA, complete cds. |
| 134 | 1823159CD1 | g1378039 | 0 | Human myotubularin (MTM1) mRNA, complete cds. |
| 135 | 232567.4 | g182718 | 0 | Human follistatin gene, exons 1–5. |
| 136 | 218419.1 | | | Incyte Unique |
| 137 | 1630551CB1 | g30302 | 0 | Human mRNA for cytochrome c1. |
| 138 | 1630551CD1 | g30302 | 0 | Human mRNA for cytochrome c1. |
| 139 | 360961.19 | g896282 | 0 | Human methionine adenosyltransferase alpha subunit gene fragment. |
| 140 | 809809CB1 | g3252871 | 0 | Human BRCA1-associated protein 2 (BRAP2) mRNA, complete cds. |
| 141 | 809809CD1 | g3252871 | 0 | Human BRCA1-associated protein 2 (BRAP2) mRNA, complete cds. |
| 142 | 2558815CB1 | g1049218 | 0 | Human gamma-aminobutyraldehyde dehydrogenase mRNA, complete cds. |
| 143 | 2558815CD1 | g1049218 | 0 | Human gamma-aminobutyraldehyde dehydrogenase mRNA, complete cds. |
| 144 | 242010.16 | g188487 | 0 | Human MHC class III HSP70-1 gene (HLA), complete cds. |
| 145 | 1678695CB1 | g5926690 | 0 | Human genomic DNA, chromosome 6p21.3, HLA Class I region, section 2/20. |
| 146 | 1678695CD1 | g5926690 | 0 | Human genomic DNA, chromosome 6p21.3, HLA Class I region, section 2/20. |
| 147 | 988653.1 | g31129 | 0 | Human mRNA for early growth response protein 1 (hEGR1). |
| 148 | 1250434CB1 | g1144012 | 0 | Human MOP1 mRNA, complete cds. |
| 149 | 1250434CD1 | g1144012 | 0 | Human MOP1 mRNA, complete cds. |
| 150 | 236196.3 | g4003383 | 0 | Human genomic DNA of 8p21.3-p22 anti-oncogene of hepatocellular colorectal and non-small cell lung c |
| 151 | 442308.1 | g3955193 | 0 | Human homeodomain protein (Nkx2.2) gene, exon 2 and complete cds. |
| 152 | 060957.1 | | | Incyte Unique |
| 153 | 014284CB1 | g1006656 | 0 | Human mRNA for cathepsin C. |
| 154 | 014284CD1 | g1006656 | 0 | Human mRNA for cathepsin C. |
| 155 | 1095192.1 | g57216 | 2.00E−75 | Rat brain mRNA for sodium channel protein I. |
| 156 | 233003.20 | | | Incyte Unique |
| 157 | 1911808CB1 | | | Incyte Unique |
| 158 | 1911808CD1 | | | Incyte Unique |
| 159 | 978276.8 | | | Incyte Unique |
| 160 | 405844.21 | g179320 | 0 | Human B61 mRNA, complete cds. |
| 161 | 405844.22 | g179320 | 0 | Human B61 mRNA, complete cds. |
| 162 | 2705515CB1 | g30820 | 0 | Human mRNA for IFN-inducible gamma2 protein. |

TABLE 3-continued

| SEQ ID NO: | TEMPLATE ID | GI Number | E-value | Annotation |
|---|---|---|---|---|
| 163 | 2705515CD1 | g30820 | 0 | Human mRNA for IFN-inducible gamma2 protein. |
| 164 | 2023119CB1 | g306769 | 0 | Human leukemia virus receptor 1 (GLVR1) mRNA, complete cds. |
| 165 | 2023119CD1 | g306769 | 0 | Human leukemia virus receptor 1 (GLVR1) mRNA, complete cds. |
| 166 | 1000084.27 | g3719220 | 0 | Human vascular endothelial growth factor mRNA, complete cds. |
| 167 | 220134.1 | g1546096 | 0 | Human hbc647 mRNA sequence. |
| 168 | 216331.1 | | | Incyte Unique |
| 169 | 206044.1 | g4529920 | 3.50E−17 | serine protease inhibitor |
| 170 | 382906.16 | g180142 | 0 | Human CD53 glycoprotein mRNA, complete cds. |
| 171 | 331306.1 | g219862 | 0 | Human mRNA for HM145. |
| 172 | 1094829.20 | g181040 | 0 | Human cAMP response element regulatory protein (CREB2) mRNA, complete cds. |
| 173 | 1094829.38 | g220087 | 0 | Human mRNA for DNA binding protein TAXREB67. |
| 174 | 1135580.4 | g2887408 | 0 | Human KIAA0417 mRNA, complete cds. |
| 175 | 196623.3 | g4929830 | 0 | Human peroxisomal D3,D2-enoyl-CoA isomerase (PEC1) mRNA, complete cds. |
| 176 | 048488.32 | g1503985 | 0 | Human mRNA for KIAA0201 gene, complete cds. |
| 177 | 2767012CB1 | g306713 | 0 | Human heat shock protein, E. coli DnaJ homologue mRNA, complete cds. |
| 178 | 2767012CD1 | g306713 | 0 | Human heat shock protein, E. coli DnaJ homologue mRNA, complete cds. |
| 179 | 1651724CB1 | g35135 | 0 | Human odc1 mRNA for ornithine decarboxylase. |
| 180 | 1651724CD1 | g35135 | 0 | Human odc1 mRNA for ornithine decarboxylase. |
| 181 | 206397.1 | g3719360 | 2.00E−34 | Human CC chemokine gene cluster, complete sequence. |
| 182 | 461707.40 | g6841321 | 0 | Human HSPC336 mRNA, partial cds. |
| 183 | 2706645CB1 | g337728 | 0 | Human S100 protein beta-subunit gene, exon 3. |
| 184 | 2706645CD1 | g337728 | 0 | Human S100 protein beta-subunit gene, exon 3. |
| 185 | 474372.7 | g1066790 | 0 | Human protein kinase-related oncogene (PIMI) mRNA, complete cds. |
| 186 | 3592543CB1 | g186624 | 0 | Human c-jun proto oncogene (JUN), complete cds, clone hCJ-1. |
| 187 | 3592543CD1 | g186624 | 0 | Human c-jun proto oncogene (JUN), complete cds, clone hCJ-1. |
| 188 | 048612.12c | g307332 | 0 | Human phosphoenolpyruvate carboxykinase (PCK1) gene, complete cds with repeats. |
| 189 | 048612.13 | g189944 | 0 | Human (clone lamda-hPEC-3) phosphoenolpyruvate carboxykinase (PCK1) mRNA, complete cds. |
| 190 | 245259.16 | g36031 | 0 | Human rhoB gene mRNA. |
| 191 | 522433CB1 | g1813326 | 0 | Human mRNA for TGF-beta superfamily protein, complete cds. |
| 192 | 522433CD1 | g1813326 | 0 | Human mRNA for TGF-beta superfamily protein, complete cds. |
| 193 | 1040667.43 | g28338 | 5.00E−94 | Human mRNA for cytoskeletal gamma-actin. |
| 194 | 2048551CB1 | g188709 | 0 | Human metallothionein I-B gene, exon 3. |
| 195 | 2048551CD1 | g188709 | 0 | Human metallothionein I-B gene, exon 3. |
| 196 | 1969731CB1 | g2344811 | 0 | Human mRNA for Drg1 protein. |
| 197 | 1969731CD1 | g2344811 | 0 | Human mRNA for Drg1 protein. |
| 198 | 1326983.14 | | | Incyte Unique |
| 199 | 2120743CB1 | | | Incyte Unique |
| 200 | 2120743CD1 | | | Incyte Unique |
| 201 | 3551330CB1 | g719268 | 0 | Human cysteine-rich heart protein (hCRHP) mRNA, complete cds. |
| 202 | 3551330CD1 | g719268 | 0 | Human cysteine-rich heart protein (hCRHP) mRNA, complete cds. |
| 203 | 1440032CB1 | g35221 | 0 | Human heat-shock protein HSP70B' gene. |
| 204 | 1440032CD1 | g35221 | 0 | Human heat-shock protein HSP70B' gene. |
| 205 | 1000133.1 | g339660 | 0 | Human thymosin beta 10 mRNA, complete cds. |
| 206 | 4020439CB1 | g296451 | 0 | Human mRNA for ribosomal protein S26. |
| 207 | 4020439CD1 | g296451 | 0 | Human mRNA for ribosomal protein S26. |
| 208 | 2507087CB1 | g6807670 | 0 | Human mRNA; cDNA DKFZp434F205 (from clone DKFZp434F205); complete cds. |
| 209 | 2507087CD1 | g6807670 | 0 | Human mRNA; cDNA DKFZp434F205 (from clone DKFZp434F205); complete cds. |
| 210 | 239996.1 | | | Incyte Unique |
| 211 | 1097380.1 | g6594626 | 0 | Human pRGR1 mRNA, partial cds. |
| 212 | 021524.2C | g598639 | 7.00E−77 | Human HepG2 3' region MboI cDNA, clone hmd2d06m3. |
| 213 | 021524.9 | g598640 | 2.00E−09 | Human HepG2 partial cDNA, clone hmd2d06m5. |
| 214 | 253987.16 | g313212 | 0 | Human Id3 gene for HLH type transcription factor. |
| 215 | 344553.1 | g469095 | 0 | Human RNA for MTP. |
| 216 | 410785.1 | g187133 | 0 | Human liver glucose transporter-like protein (GLUT2), complete cds. |
| 217 | 237623.6 | g402482 | 0 | Human secretory protein (P1.B) mRNA, complete cds. |
| 218 | 076047.1 | g1688257 | 0 | Human collagenase and stromelysin genes, complete cds, and metalloelastasegene, partial cds. |
| 219 | 1099500.15 | g3287488 | 0 | Human Hsp89-alpha-delta-N mRNA, complete cds. |
| 220 | 1099500.18 | g32487 | 0 | Human mRNA for 90-kDa heat-shock protein. |
| 221 | 2278688CB1 | g4210725 | 0 | Human mRNA for puromycin sensitive aminopeptidase, partial. |
| 222 | 2278688CD1 | g4210725 | 0 | Human mRNA for puromycin sensitive aminopeptidase, partial. |
| 223 | 380283.1 | g2564321 | 0 | Human mRNA for KIAA0287 gene, partial cds. |
| 224 | 1720847CB1 | g4218425 | 6.00E−11 | Human pex3 gene (joined cds, promoter and exon 1). |
| 225 | 1720847CD1 | g4218425 | 6.00E−11 | Human pex3 gene (joined cds, promoter and exon 1). |
| 226 | 333776.1c | | | Incyte Unique |
| 227 | 3478236CB1 | g179039 | 0 | Human amphiregulin (AR) mRNA, complete cds, clones lambda-AR1 and lambda-AR2. |
| 228 | 3478236CD1 | g179039 | 0 | Human amphiregulin (AR) mRNA, complete cds, clones lambda-AR1 and lambda-AR2. |
| 229 | 147541.17 | g6899845 | 0 | Human mRNA for cisplatin resistance-associated overexpressed protein, complete cds. |
| 230 | 331120.16c | g663009 | 0 | Human PHKLA mRNA. |
| 231 | 575983CB1 | g2546963 | 0 | Human mRNA for diubiquitin. |

TABLE 3-continued

| SEQ ID NO: | TEMPLATE ID | GI Number | E-value | Annotation |
|---|---|---|---|---|
| 232 | 575983CD1 | g2546963 | 0 | Human mRNA for diubiquitin. |
| 233 | 413268.6 | g541677 | 0 | Human HBZ17 mRNA. |
| 234 | 1989186CB1 | g2708328 | 0 | Human atrophin-1 interacting protein 4 (AIP4) mRNA, partial cds. |
| 235 | 1989186CD1 | g2708328 | 0 | Human atrophin-1 interacting protein 4 (AIP4) mRNA, partial cds. |
| 236 | 337448.1c | g5912019 | 0 | Human mRNA; cDNA DKFZp434H0735 (from clone DKFZp434H0735); partial cds. |
| 237 | 228304.19 | | | Incyte Unique |
| 238 | 420527.25 | g186757 | 0 | Human protein kinase mRNA. |
| 239 | 998034.3 | g927597 | 0 | Human transcription factor TFIIIB 90 kDa subunit (hTFIIIB90) mRNA, complete cds. |
| 240 | 474165.26 | g3005586 | 0 | Human Ser/Arg-related nuclear matrix protein (SRM160) mRNA, complete cds. |
| 241 | 697785CB1 | g187109 | 0 | Human 14 kd lectin mRNA, complete cds. |
| 242 | 697785CD1 | g187109 | 0 | Human 14 kd lectin mRNA, complete cds. |
| 243 | 346209.3 | g4240220 | 3.00E−14 | Human mRNA for KIAA0866 protein, complete cds. |
| 244 | 167772CB1 | g3954884 | 0 | Human mRNA for Ig kappa light chain, anti-RhD, therad 7. |
| 245 | 167772CD1 | g3954884 | 0 | Human mRNA for Ig kappa light chain, anti-RhD, therad 7. |
| 246 | 2514988CB1 | g178848 | 0 | Human apolipoprotein E mRNA, complete cds. |
| 247 | 2514988CD1 | g178848 | 0 | Human apolipoprotein E mRNA, complete cds. |
| 248 | 481231.16 | g28771 | 0 | Human mRNA for apolipoprotein AI (apo AI)=. |
| 249 | 481231.17 | g28771 | 0 | Human mRNA for apolipoprotein AI (apo AI)=. |
| 250 | 1045853.2 | g763428 | 0 | Human mRNA clone with similarity to L-glycerol-3-phosphate:NAD oxidoreductase and albumin gene se |
| 251 | 336615.1 | g2072161 | 0 | Human tubby related protein 1 (TULP1) mRNA, complete cds. |
| 252 | 1328423.2 | g682747 | 0 | Human mRNA for Apol_Human (MER5(Aopl-Mouse)-like protein), complete cds. |
| 253 | 085282.1 | | | Incyte Unique |
| 254 | 1081605.3 | g6466185 | 0 | Human zinc finger protein ZNF228 (ZNF228) mRNA, complete cds. |
| 255 | 1053517.1 | g7339817 | 0.15 | *Mus musculus* DNA methyltransferase (Dnmt1) gene, exon 28. |
| 256 | 480169.76 | g2921872 | 0 | Human spleen mitotic checkpoint BUB3 (BUB3) mRNA, complete cds. |
| 257 | 2636043CB1 | | | Incyte Unique |
| 258 | 2636043CD1 | | | Incyte Unique |
| 259 | 2993696CB1 | g1143491 | 0 | Human mRNA for BiP protein. |
| 260 | 2993696CD1 | g1143491 | 0 | Human mRNA for BiP protein. |
| 261 | 240518.21 | g6841489 | 1.00E−80 | Human HSPC134 mRNA, complete cds. |
| 262 | 240518.34 | g6841489 | 0 | Human HSPC134 mRNA, complete cds. |
| 263 | 001322.4c | | | Incyte Unique |
| 264 | 350502.3 | g3978170 | 4.00E−36 | *Mus musculus* lysyl oxidase-related protein 2 (Lor2) mRNA, |
| 265 | 350502.4c | g2661055 | 6.00E−25 | Human clone 23863 mRNA, partial cds. |
| 266 | 253783.3 | g2664429 | 6.40E−43 | hypothetical protein |
| 267 | 085119.1 | g1000863 | 0 | Human DNA-binding protein (Fli-1) gene, 5' end of cds. |
| 268 | 902559.1 | g183990 | 0 | Human epidermal growth factor receptor (HER3) mRNA, complete cds. |
| 269 | 4113161CB1 | g3360429 | 0 | Human clone 23929 mRNA sequence. |
| 270 | 4113161CD1 | g3360429 | 0 | Human clone 23929 mRNA sequence. |
| 271 | 2757583CB1 | g187542 | 0 | Human metallothionein (MT)I-F gene, complete cds. |
| 272 | 2757583CD1 | g187542 | 0 | Human metallothionein (MT)I-F gene, complete cds. |
| 273 | 198317.1 | g183398 | 3.00E−36 | Human guanine nucleotide-binding protein alpha-subunit gene (G-s-alpha), exon 2. |
| 274 | 1508254CB1 | g587201 | 0 | Human HK2 mRNA for hexokinase II. |
| 275 | 1508254CD1 | g587201 | 0 | Human HK2 mRNA for hexokinase II. |
| 276 | 474691.3 | | | Incyte Unique |
| 277 | 2457215CB1 | g38457 | 0 | Human mRNA for PTB-associated splicing factor. |
| 278 | 2457215CD1 | g38457 | 0 | Human mRNA for PTB-associated splicing factor. |
| 279 | 201395.4c | g2224626 | 0 | Human mRNA for KIAA0343 gene, complete cds. |
| 280 | 233189.21 | g189869 | 0 | Human phosphoglycerate mutase 2 (muscle specific isozyme) (PGAM2) gene, 5' end. |
| 281 | 196606.6C | g2924334 | 0 | Human mRNA for exportin (tRNA). |
| 282 | 196606.8c | g2924334 | 0 | Human mRNA for exportin (tRNA). |
| 283 | 1040190.3 | g187518 | 0 | Human MEM-102 glycoprotein mRNA, complete cds. |
| 284 | 1427459CB1 | g2437832 | 0 | Human mRNA for RNF3A (DONG1) ring finger protein. |
| 285 | 1427459CD1 | g2437832 | 0 | Human mRNA for RNF3A (DONG1) ring finger protein. |
| 286 | 480453.16c | g4512253 | 0 | Human gene for JKTBP2, JKTBP1, complete cds. |
| 287 | 1095604.1 | g1143491 | 0 | Human mRNA for BiP protein. |
| 288 | 241291.28 | g3327107 | 0 | Human mRNA for KIAA0647 protein, partial cds. |
| 289 | 230611.1 | g1321847 | 4.00E−28 | Human mRNA for U61 small nuclear RNA. |
| 290 | 3993708CB1 | g339660 | 0 | Human thymosin beta 10 mRNA, complete cds. |
| 291 | 3993708CD1 | g339660 | 0 | Human thymosin beta 10 mRNA, complete cds. |
| 292 | 1000133.12 | g264772 | 0 | thymosin beta-10 [Human, metastatic melanoma cell line, mRNA, 453 nt]. |
| 293 | 400253.17c | g6016843 | 5.00E−23 | Human genomic DNA, chromosome 22q11.2, clone KB1561E1. |
| 294 | 400253.5 | g2826476 | 1.00E−13 | IL-17 receptor [*Homo sapiens*] |
| 295 | 030882CB1 | g1617087 | 0 | Human mRNA for hBD-1 protein. |
| 296 | 030882CD1 | g1617087 | 0 | Human mRNA for hBD-1 protein. |
| 297 | 898779CB1 | g179530 | 0 | Human IgE-binding protein (epsilon-BP) mRNA, complete cds. |
| 298 | 898779CD1 | g179530 | 0 | Human IgE-binding protein (epsilon-BP) mRNA, complete cds. |
| 299 | 3727408CB1 | g189944 | 0 | Human (clone lamda-hPEC-3) phosphoenolpyruvate carboxykinase (PCK1) mRNA, complete cds. |

TABLE 3-continued

| SEQ ID NO: | TEMPLATE ID | GI Number | E-value | Annotation |
|---|---|---|---|---|
| 300 | 3727408CD1 | g189944 | 0 | Human (clone lamda-hPEC-3) phosphoenolpyruvate carboxykinase (PCK1) mRNA, complete cds. |
| 301 | 984236.1c | | | Incyte Unique |
| 302 | 984236.2c | | | Incyte Unique |
| 303 | 348082.5 | g3868777 | | *Rattus norvegicus* mRNA for atypical PKC specific binding |
| 304 | 348082.7 | g3868778 | 0 | atypical PKC specific binding protein [*Rattus norvegicus*] |
| 305 | 1097910.1 | g181275 | 0 | Human cytochrome P1-450 (TCDD-inducible) mRNA, complete cds. |
| 306 | 246841.1 | g6453594 | 0 | Human mRNA; cDNA DKFZp566M0947 (from clone DKFZp566M0947). |
| 307 | 351241.1 | g2935483 | 4.00E−56 | Human minisatellite ceb 1 repeat region. |
| 308 | 2790762CB1 | | | Incyte Unique |
| 309 | 2790762CD1 | | | Incyte Unique |
| 310 | 2253717CB1 | g7542489 | | *Homo sapiens* FK506 binding protein precursor (FKBP22) |
| 311 | 2253717CD1 | | | Incyte Unique |
| 312 | 2655184CB1 | g5531903 | 0 | Human pre-mRNA splicing factor (SFRS3) mRNA, complete cds. |
| 313 | 2655184CD1 | g5531903 | 0 | Human pre-mRNA splicing factor (SFRS3) mRNA, complete cds. |
| 314 | 363000.9c | g5531903 | 0 | Human pre-mRNA splicing factor (SFRS3) mRNA, complete cds. |
| 315 | 232818.15 | g3329377 | 0 | Human vacuolar H(+)-ATPase subunit mRNA, complete cds. |
| 316 | 347781.10 | g1051169 | 0 | Human GAP SH3 binding protein mRNA, complete cds. |
| 317 | 2477616CB1 | g1051169 | 0 | Human GAP SH3 binding protein mRNA, complete cds. |
| 318 | 2477616CD1 | g1051169 | 0 | Human GAP SH3 binding protein mRNA, complete cds. |
| 319 | 360532.1 | g37207 | 0 | Human mRNA for slow skeletal troponin C (TnC). |
| 320 | 360532.9 | g37207 | 0 | Human mRNA for slow skeletal troponin C (TnC). |
| 321 | 110245.1 | g3213194 | 0 | Human serine-threonine kinase (BTAK) gene, partial cds. |
| 322 | 478620.53 | g386156 | 0 | TLS = translocated in liposarcoma [Human, mRNA, 1824 nt]. |
| 323 | 1813444CB1 | g386158 | 0 | TLS/CHOP = hybrid gene {translocation breakpoint} [Human, myxoid liposarcomas cells, mRNA Mutant, |
| 324 | 1813444CD1 | g386158 | 0 | TLS/CHOP = hybrid gene {translocation breakpoint} [Human, myxoid liposarcomas cells, mRNA Mutant, |
| 325 | 474588.21 | g339700 | 0 | Human polyadenylate binding protein (TIA-1) mRNA, complete cds. |
| 326 | 407838.1 | | | Incyte Unique |
| 327 | 994387.19 | g6808610 | 2.00E−14 | Human 88-kDa Golgi protein (GM88) mRNA, complete cds. |
| 328 | 347796.7 | g710405 | 2.8 | 35 kDa protein [*Bartonella henselae*] |
| 329 | 406498.4c | | | Incyte Unique |
| 330 | 3346307CB1 | | | Incyte Unique |
| 331 | 3346307CD1 | | | Incyte Unique |
| 332 | 4005778CB1 | g182513 | 0 | Human ferritin L chain mRNA, complete cds. |
| 333 | 4005778CD1 | g182513 | 0 | Human ferritin L chain mRNA, complete cds. |
| 334 | 995575.17 | g189066 | 0 | Human NAP (nucleosome assembly protein) mRNA, complete cds. |
| 335 | 863406CB1 | g3327203 | 0 | Human mRNA for KIAA0695 protein, complete cds. |
| 336 | 863406CD1 | g3327203 | 0 | Human mRNA for KIAA0695 protein, complete cds. |
| 337 | 413864.17 | | | Incyte Unique |
| 338 | 350106.16 | g183059 | 0 | Human glutamate dehydrogenase (GDH) mRNA, complete cds. |
| 339 | 399785.1 | | | Incyte Unique |
| 340 | 010498.19 | g4240316 | 0 | Human mRNA for KIAA0914 protein, complete cds. |
| 341 | 255824.39 | g28596 | 0 | Human fibroblast mRNA for aldolase A. |
| 342 | 2706606CB1 | g178350 | 0 | Human aldolase A mRNA, complete cds. |
| 343 | 2706606CD1 | g178350 | 0 | Human aldolase A mRNA, complete cds. |
| 344 | 118006.1 | g2290764 | 5.00E−86 | Human gonadotropin releasing hormone receptor (GNRHR) gene, exon 1. |
| 345 | 1039889.26 | g28338 | 0 | Human mRNA for cytoskeletal gamma-actin. |
| 346 | 481480.7 | g561665 | 0 | Human cysteine protease CPP32 isoform alpha mRNA, complete cds. |
| 347 | 662575CB1 | | | Incyte Unique |
| 348 | 662575CD1 | | | Incyte Unique |
| 349 | 027619.3 | | | Incyte Unique |
| 350 | 235447.5 | g37432 | 0 | Human mRNA for transferrin receptor. |
| 351 | 331104.2 | g451209 | 0 | Human mRNA for histidase, complete cds. |
| 352 | 348390.2 | g36502 | 0 | Human mRNA for enteric smooth muscle gamma-actin. |
| 353 | 127004.1 | | | Incyte Unique |
| 354 | 026190.1 | | | Incyte Unique |
| 355 | 250330.1 | g456587 | 4.00E−80 | Human granulocyte-macrophage colony stimulating factor (GM-CSF) receptor alpha subunit gene, exon 1 |
| 356 | 480375.28 | g5360203 | 5.00E−27 | Human A-kinase anchor protein (AKAP100) mRNA, complete cds. |
| 357 | 364726.10 | g498012 | 0 | Human X104 mRNA, complete cds. |
| 358 | 364726.12 | g498012 | 0 | Human X104 mRNA, complete cds. |
| 359 | 1505038CB1 | g536897 | 0 | Human follistatin-related protein precursor mRNA, complete cds. |
| 360 | 1505038CD1 | g536897 | 0 | Human follistatin-related protein precursor mRNA, complete cds. |
| 361 | 903508.12 | g5262490 | 0 | Human mRNA; cDNA DKFZp564D0462 (from clone DKFZp564D0462). |
| 362 | 346716.17c | g1147782 | 0 | Human myosin-IXb mRNA, complete cds. |
| 363 | 346716.21c | | | Incyte Unique |
| 364 | 330776.1 | | | Incyte Unique |
| 365 | 407999.1c | | | Incyte Unique |
| 366 | 1719478CB1 | g758109 | 0 | Human mRNA for voltage-activated sodium channel. |
| 367 | 1719478CD1 | g758109 | 0 | Human mRNA for voltage-activated sodium channel. |
| 368 | 351157.2 | g31139 | 6.00E−64 | Human EMX1 mRNA. |
| 369 | 088957CB1 | g763428 | 0 | Human mRNA clone with similarity to L-glycerol-3-phosphate:NAD oxidoreductase and albumin gene sc |

TABLE 3-continued

| SEQ ID NO: | TEMPLATE ID | GI Number | E-value | Annotation |
|---|---|---|---|---|
| 370 | 088957CD1 | g763428 | 0 | Human mRNA clone with similarity to L-glycerol-3-phosphate:NAD oxidoreductase and albumin gene sc |
| 371 | 980446.1 | g2769702 | 0.088 | chondroitin-6-sulfotransferase [*Homo sapiens*] |
| 372 | 198827.1 | g1017792 | 0 | Human substance P beta-PPT-A mRNA, complete cds. |
| 373 | 1102297.22 | g28335 | 0 | Human ACTB mRNA for mutant beta-actin (beta'-actin). |
| 374 | 215112.1 | g4240476 | 0 | Human short chain L-3-hydroxyacyl-CoA dehydrogenase precursor (HADHSC) gene, nuclear gene encod |
| 375 | 171495.1 | g5102577 | 0 | Human mRNA full length insert cDNA clone EUROIMAGE 345330. |
| 376 | 242010.43 | g5926690 | 0 | Human genomic DNA, chromosome 6p21.3, HLA Class I region, section 2/20. |
| 377 | 5834958CB1 | g881474 | 0 | Human pephBGT-1 betaine-GABA transporter mRNA, complete cds. |
| 378 | 5834958CD1 | g881474 | 0 | Human pephBGT-1 betaine-GABA transporter mRNA, complete cds. |
| 379 | 335648.1c | g36712 | 0 | Human mRNA for tyrosine aminotransferase (TAT) (EC 2.6.1.5). |
| 380 | 333840.1 | g452443 | 0 | Human glucose-6-phosphatase mRNA, complete cds. |
| 381 | 480885.2 | g2394309 | 0 | Human homeobox protein MEIS2 (MEIS2) mRNA, partial cds. |
| 382 | 998106.8c | g174918 | 5.00E−13 | Human Ala-tRNA. |
| 383 | 400701.4 | | | Incyte Unique |
| 384 | 1100320.4 | g1209060 | 0 | Human cytoplasmic dynein light chain 1 (hdlc1) mRNA, complete cds. |
| 385 | 246727.11 | g337456 | 0 | Human ribonucleoprotein (La) mRNA, 3' end. |
| 386 | 246727.17 | g178686 | 0 | Human La protein mRNA, complete cds. |
| 387 | 1102322.12c | g32466 | 0 | Human hsc70 gene for 71 kd heat shock cognate protein. |
| 388 | 1102322.18 | g313283 | 0 | African green monkey hsp70 mRNA. |
| 389 | 2070610CB1 | g338696 | 0 | Human thyroxine-binding globulin mRNA, complete cds. |
| 390 | 2070610CD1 | g338696 | 0 | Human thyroxine-binding globulin mRNA, complete cds. |
| 391 | 336733.3 | g6049603 | 0 | Human dickkopf-1 (DKK-1) mRNA, complete cds. |
| 392 | 1326902.13 | g219909 | 0 | Human mRNA for lipocortin II, complete cds. |
| 393 | 1326902.6 | g219909 | 0 | Human mRNA for lipocortin II, complete cds. |
| 394 | 013521.16 | g37611 | 0 | Human urf-ret mRNA. |
| 395 | 985369.1 | g310099 | 2.00E−36 | Rattus norvegicus developmentally regulated protein mRNA, |
| 396 | 002455.1 | | | Incyte Unique |
| 397 | 372647.1 | | | Incyte Unique |
| 398 | 208075.1 | g23915 | 3.00E−49 | Human 7SK RNA gene and flanking regions. |
| 399 | 209279.1 | g2342725 | 3.6 | hypothetical protein [*Arabidopsis thaliana*] |
| 400 | 381058.1 | g1021027 | 0 | Human CpG island DNA genomic MseI fragment, clone 181h1, reverse read cpg181h1.rt1c. |
| 401 | 046977.1 | g4028582 | 1.00E−12 | Human connective tissue growth factor related protein WISP-2 (WISP2) mRNA, complete cds. |

TABLE 4

| SEQ ID NO: | TEMPLATE II | START | STOP | FRAME | Pfam ID | Pfam Description | E-value |
|---|---|---|---|---|---|---|---|
| 1 | 220060.4 | 1 | 441 | forward 1 | Transthyretin | Transthyretin precursor (formerly prealbumin) | 8.20E−103 |
| 6 | 3201389CD1 | 43 | 326 | | 7tm_1 | 7 transmembrane receptor (rhodopsin family) | 4.20E−103 |
| 8 | 086390CD1 | 21 | 130 | | SAA_proteins | Serum amyloid A protein | 3.00E−85 |
| 9 | 1102322.16 | 3 | 803 | forward 3 | HSP70 | Hsp70 protein | 2.40E−12 |
| 11 | 1545176CD1 | 6 | 612 | | HSP70 | Hsp70 protein | 0.00E+00 |
| 12 | 978222.4 | 1 | 159 | forward 1 | HLH | Helix-loop-helix DNA-binding domain | 1.10E−10 |
| 15 | 1720920CD1 | 55 | 181 | | laminin_G | Laminin G domain | 2.00E−25 |
| 17 | 1857017CD1 | 475 | 871 | | HMG-CoA_re | Hydroxymethylglutaryl-coenzyme A reductase | 1.10E−298 |
| 19 | 2114865CD1 | 46 | 420 | | serpin | Serpins (serine protease inhibitors) | 1.60E−216 |
| 21 | 2700132CD1 | 27 | 91 | | FHA | FHA domain | 4.30E−21 |
| 22 | 238349.2 | 379 | 837 | forward 1 | SCP | SCP-like extracellular protein | 1.40E−34 |
| 27 | 2516070CD1 | 2 | 265 | | Apolipoprotein | Apolipoprotein A1/A4/E family | 2.00E−137 |
| 29 | 167507CD1 | 266 | 370 | | cystatin | Cystatin domain | 3.40E−39 |
| 31 | 3860413CD1 | 1 | 61 | | metalthio | Metallothionein | 2.10E−25 |
| 33 | 3393861CD1 | 234 | 484 | | fibrinogen_C | Fibrinogen beta and gamma chains, C-terminal globular domain | 3.00E−179 |
| 35 | 2517374CD1 | 38 | 183 | | lipocalin | Lipocalin/cytosolic fatty-acid binding protein family | 2.10E−33 |
| 36 | 030850.7 | 1 | 396 | forward 1 | arf | ADP-ribosylation factor family | 1.30E−05 |
| 40 | 1269631CD1 | 1651 | 1735 | | fn3 | Fibronectin type III domain | 9.40E−10 |
| 40 | 1269631CD1 | 1197 | 1237 | | ldl_recept_a | Low-density lipoprotein receptor domain class A | 2.50E−17 |
| 40 | 1269631CD1 | 888 | 931 | | ldl_recept_b | Low-density lipoprotein receptor repeat class B | 2.00E−06 |
| 47 | 476301CD1 | 28 | 586 | | transketolase | Transketolase | 7.20E−124 |
| 54 | 978740.3 | 1182 | 1487 | forward 3 | PH | PH domain | 5.10E−06 |
| 54 | 978740.3 | 516 | 1049 | forward 3 | RhoGEF | RhoGEF domain | 1.10E−23 |
| 58 | 2797839CD1 | 300 | 585 | | Nol1_Nop2_S | Nol1/NOP2/sun family | 2.80E−157 |
| 60 | 348072.5 | 860 | 1411 | forward 2 | vwa | von Willebrand factor type A domain | 8.80E−13 |
| 62 | 085596CD1 | 17 | 126 | | cystatin | Cystatin domain | 3.10E−25 |
| 66 | 3603037CD1 | 340 | 364 | | zf-C2H2 | Zinc finger, C2H2 type | 5.50E−07 |
| 68 | 088564CD1 | 24 | 89 | | IL8 | Small cytokines (intecrine/chemokine), interleukin-8 like | 2.50E−10 |

TABLE 4-continued

| SEQ ID NO: | TEMPLATE II | START | STOP | FRAME | Pfam ID | Pfam Description | E-value |
|---|---|---|---|---|---|---|---|
| 70 | 407096.2 | 1111 | 1953 | forward 1 | pyr_redox | Pyridine nucleotide-disulphide oxidoreductase class-I | 7.60E−05 |
| 70 | 407096.2 | 593 | 1489 | forward 2 | pyr_redox | Pyridine nucleotide-disulphide oxidoreductase class-I | 3.20E−06 |
| 70 | 407096.2 | 786 | 1730 | forward 3 | pyr_redox | Pyridine nucleotide-disulphide oxidoreductase class-I | 1.70E−09 |
| 71 | 209265.54 | 2041 | 2250 | forward 1 | SH3 | SH3 domain | 1.30E−05 |
| 73 | 701484CD1 | 8 | 614 | | HSP70 | Hsp70 protein | 0.00E+00 |
| 74 | 251859.2 | 348 | 632 | forward 3 | FKBP | FKBP-type peptidyl-prolyl cis-trans isomerases | 9.40E−49 |
| 76 | 3766715CD1 | 170 | 198 | | TPR | TPR Domain | 7.70E−04 |
| 83 | 1434821CD1 | 30 | 71 | | trefoil | Trefoil (P-type) domain | 1.00E−24 |
| 84 | 289671.27 | 1273 | 1614 | forward 1 | GSHPx | Glutathione peroxidases | 4.40E−68 |
| 86 | 1282225CD1 | 2 | 127 | | lipocalin | Lipocalin/cytosolic fatty-acid binding protein family | 6.90E−25 |
| 87 | 263336.57 | 55 | 171 | forward 1 | metalthio | Metallothionein | 8.20E−06 |
| 88 | 464689.40 | 443 | 631 | forward 2 | cystatin | Cystatin domain | 6.90E−21 |
| 91 | 243794.23 | 270 | 434 | forward 1 | Ribosomal_S1 | Ribosomal protein S14p/S29e | 6.80E−19 |
| 98 | 347055.4 | 279 | 1649 | forward 3 | HMG_CoA_sy | Hydroxymethylglutaryl-coenzyme A synthase | 0.00E+00 |
| 99 | 898899.11 | 661 | 1266 | forward 1 | trypsin | Trypsin | 2.10E−39 |
| 99 | 898899.11 | 281 | 517 | forward 2 | kringle | Kringle domain | 1.50E−50 |
| 100 | 898899.32 | 1222 | 1383 | forward 1 | kringle | Kringle domain | 5.60E−09 |
| 100 | 898899.32 | 379 | 609 | forward 1 | PAN | PAN domain | 1.50E−06 |
| 100 | 898899.32 | 1367 | 1543 | forward 2 | kringle | Kringle domain | 1.10E−07 |
| 100 | 898899.32 | 2141 | 2785 | forward 2 | trypsin | Trypsin | 4.50E−46 |
| 100 | 898899.32 | 723 | 965 | forward 3 | kringle | Kringle domain | 1.40E−21 |
| 102 | 2047630CD1 | 206 | 557 | | Asn_synthase | Asparagine synthase | 9.00E−261 |
| 102 | 2047630CD1 | 2 | 148 | | GATase_2 | Glutamine amidotransferases class-II | 9.90E−65 |
| 103 | 1039889.8 | 265 | 1002 | forward 1 | actin | Actin | 2.40E−83 |
| 103 | 1039889.8 | 968 | 1204 | forward 2 | actin | Actin | 5.30E−43 |
| 103 | 1039889.8 | 1281 | 1694 | forward 3 | actin | Actin | 4.40E−67 |
| 105 | 1272969CD1 | 79 | 391 | | filament | Intermediate filament proteins | 4.30E−157 |
| 109 | 1448817CD1 | 30 | 89 | | IGFBP | insulin-like growth factor binding proteins | 2.20E−23 |
| 109 | 1448817CD1 | 176 | 251 | | thyroglobulin_ | Thyroglobulin type-1 repeat | 5.50E−40 |
| 110 | 1100769.2 | 262 | 603 | forward 2 | Ribosomal_S2 | Ribosomal protein S26e | 9.20E−75 |
| 110 | 1100769.2 | 663 | 884 | forward 3 | Ribosomal_S2 | Ribosomal protein S26e | 9.80E−30 |
| 112 | 225080.16 | 510 | 641 | forward 3 | prenyltrans | Prenyltransferase and squalene oxidase repeat | 6.50E−13 |
| 113 | 334851.5 | 138 | 452 | forward 3 | CH | Calponin homology (CH) domain | 2.00E−25 |
| 114 | 995529.7 | 46 | 726 | forward 1 | pkinase | Eukaryotic protein kinase domain | 6.00E−46 |
| 115 | 995529.8 | 53 | 766 | forward 2 | pkinase | Eukaryotic protein kinase domain | 1.00E−87 |
| 115 | 995529.8 | 795 | 872 | forward 3 | pkinase | Eukaryotic protein kinase domain | 2.70E−07 |
| 116 | 201851.1 | 1634 | 1750 | forward 2 | WD40 | WD domain, G-beta repeat | 1.20E−08 |
| 118 | 059509CD1 | 153 | 280 | | TNF | TNF (Tumor Necrosis Factor) family | 4.00E−15 |
| 119 | 481231.14 | 112 | 573 | forward 1 | Apolipoprotein | Apolipoprotein A1/A4/E family | 5.80E−34 |
| 124 | 153825.1 | 820 | 951 | forward 1 | hemopexin | Hemopexin | 3.80E−14 |
| 124 | 153825.1 | 42 | 497 | forward 3 | Peptidase_M 1 | Matrixin | 5.70E−13 |
| 127 | 1459432CD1 | 57 | 311 | | 7tm_1 | 7 transmembrane receptor (rhodopsin family) | 2.30E−64 |
| 130 | 516300CD1 | 87 | 174 | | lectin_c | Lectin C-type domain | 7.50E−05 |
| 132 | 627856CD1 | 143 | 239 | | tRNA_bind | Putative tRNA binding domain | 5.80E−46 |
| 135 | 232567.4 | 902 | 1042 | forward 2 | kazal | Kazal-type serine protease inhibitor domain | 2.30E−17 |
| 139 | 360961.19 | 1186 | 1266 | forward 1 | S-AdoMet_syn | S-adenosylmethionine synthetase | 1.80E−22 |
| 139 | 360961.19 | 149 | 604 | forward 2 | S-AdoMet_syn | S-adenosylmethionine synthetase | 4.00E−87 |
| 141 | 809809CD1 | 264 | 303 | | zf-C3HC4 | Zinc finger, C3HC4 type (RING finger) | 8.10E−06 |
| 143 | 2558815CD1 | 45 | 511 | | aldedh | Aldehyde dehydrogenase family | 3.50E−216 |
| 144 | 242010.16 | 217 | 2037 | forward 1 | HSP70 | Hsp70 protein | 0.00E+00 |
| 146 | 1678695CD1 | 6 | 612 | | HSP70 | Hsp70 protein | 0.00E+00 |
| 147 | 988653.1 | 1295 | 1369 | forward 2 | zf-C2H2 | Zinc finger, C2H2 type | 1.00E−06 |
| 149 | 1250434CD1 | 303 | 346 | | PAC | PAC motif | 1.60E−10 |
| 151 | 442308.1 | 294 | 464 | forward 3 | homeobox | Homeobox domain | 2.70E−27 |
| 154 | 014284CD1 | 231 | 458 | | Peptidase_C1 | Papain family cysteine protease | 8.30E−106 |
| 160 | 405844.21 | 133 | 498 | forward 1 | Ephrin | Ephrin | 7.60E−80 |
| 161 | 405844.22 | 157 | 573 | forward 1 | Ephrin | Ephrin | 1.30E−96 |
| 163 | 2705515CD1 | 158 | 381 | | tRNA-synt_1b | tRNA synthetases class I (W and Y) | 1.10E−37 |
| 163 | 2705515CD1 | 12 | 68 | | WHEP-TRS | WHEP-TRS domain containing proteins | 2.90E−30 |
| 165 | 2023119CD1 | 39 | 665 | | PHO4 | Phosphate transporter family | 0.00E+00 |
| 166 | 1000084.27 | 152 | 1423 | forward 2 | tubulin | Tubulin/FtsZ family | 2.40E−279 |
| 169 | 206044.1 | 248 | 532 | forward 2 | serpin | Serpins (serine protease inhibitors) | 7.10E−25 |
| 170 | 382906.16 | 182 | 226 | forward 2 | transmembrane | Transmembrane 4 family | 4.40E−04 |
| 171 | 331306.1 | 967 | 1029 | forward 1 | 7tm_1 | 7 transmembrane receptor (rhodopsin family) | 8.90E−08 |
| 171 | 331306.1 | 312 | 1001 | forward 3 | 7tm_1 | 7 transmembrane receptor (rhodopsin family) | 2.50E−88 |
| 172 | 1094829.20 | 1365 | 1559 | forward 3 | bZIP | bZIP transcription factor | 2.90E−19 |
| 173 | 1094829.38 | 1692 | 1886 | forward 3 | bZIP | bZIP transcription factor | 2.90E−19 |
| 175 | 196623.3 | 511 | 984 | forward 1 | ECH | Enoyl-CoA hydratase/isomerase family | 3.80E−06 |
| 175 | 196623.3 | 159 | 413 | forward 3 | ACBP | Acyl CoA binding protein | 6.10E−40 |
| 176 | 048488.32 | 348 | 2465 | forward 3 | HSP70 | Hsp70 protein | 2.70E−220 |
| 178 | 2767012CD1 | 6 | 68 | | DnaJ | DnaJ domain | 1.40E−34 |
| 178 | 2767012CD1 | 220 | 346 | | DnaJ_C | DnaJ C terminal region | 2.50E−07 |

TABLE 4-continued

| SEQ ID NO: | TEMPLATE II | START | STOP | FRAME | Pfam ID | Pfam Description | E-value |
|---|---|---|---|---|---|---|---|
| 178 | 2767012CD1 | 121 | 207 | | DnaJ_CXXCX | DnaJ central domain (4 repeats) | 5.80E-43 |
| 180 | 1651724CD1 | 40 | 400 | | Orn_DAP_Arg | Pyridoxal-dependent decarboxylase | 2.30E-202 |
| 184 | 2706645CD1 | 53 | 81 | | efhand | EF hand | 5.90E-06 |
| 184 | 2706645CD1 | 4 | 47 | | S_100 | S-100/ICaBP type calcium binding domain | 3.60E-23 |
| 185 | 474372.7 | 406 | 1164 | forward 1 | pkinase | Eukaryotic protein kinase domain | 3.80E-88 |
| 187 | 3592543CD1 | 250 | 314 | | bZIP | bZIP transcription factor | 4.90E-22 |
| 189 | 048612.13 | 203 | 1984 | forward 2 | PEPCK | Phosphoenolpyruvate carboxykinase | 0.00E+00 |
| 190 | 245259.16 | 398 | 955 | forward 2 | ras | Ras family | 6.90E-91 |
| 192 | 522433CD1 | 211 | 308 | | TGF-beta | Transforming growth factor beta like domain | 6.80E-19 |
| 195 | 2048551CD1 | 1 | 61 | | metalthio | Metallothionein | 1.80E-24 |
| 198 | 1326983.14 | 518 | 1768 | forward 2 | Aa_trans | Transmembrane amino acid transporter protein | 9.50E-15 |
| 198 | 1326983.14 | 518 | 1768 | forward 2 | Aa_trans | Transmembrane amino acid transporter protein | 9.50E-15 |
| 202 | 3551330CD1 | 4 | 61 | | LIM | LIM domain containing proteins | 2.10E-19 |
| 204 | 1440032CD1 | 8 | 614 | | HSP70 | Hsp70 protein | 0.00E+00 |
| 205 | 1000133.1 | 199 | 321 | forward 1 | Thymosin | Thymosin beta-4 family | 1.90E-21 |
| 207 | 4020439CD1 | 1 | 114 | | Ribosomal_S2 | Ribosomal protein S26e | 4.70E-67 |
| 213 | 021524.9 | 318 | 434 | forward 3 | WD40 | WD domain, G-beta repeat | 1.80E-06 |
| 215 | 344553.1 | 159 | 1820 | forward 3 | Vitellogenin_ | Lipoprotein amino terminal region | 1.80E-160 |
| 216 | 410785.1 | 72 | 1535 | forward 3 | sugar_tr | Sugar (and other) transporter | 2.40E-200 |
| 217 | 237623.6 | 155 | 280 | forward 2 | trefoil | Trefoil (P-type) domain | 2.00E-25 |
| 219 | 1099500.15 | 466 | 1116 | forward 1 | HSP90 | Hsp90 protein | 1.20E-128 |
| 219 | 1099500.15 | 263 | 472 | forward 2 | HSP90 | Hsp90 protein | 5.50E-41 |
| 219 | 1099500.15 | 102 | 287 | forward 3 | HSP90 | Hsp90 protein | 1.00E-41 |
| 220 | 1099500.18 | 1187 | 1630 | forward 2 | HSP90 | Hsp90 protein | 1.70E-113 |
| 220 | 1099500.18 | 480 | 2609 | forward 3 | HSP90 | Hsp90 protein | 0.00E+00 |
| 222 | 2278688CD1 | 54 | 441 | | Peptidase_M1 | Peptidase family M1 | 2.90E-234 |
| 223 | 380283.1 | 111 | 392 | forward 3 | SCAN | SCAN domain | 2.80E-11 |
| 223 | 380283.1 | 2889 | 2957 | forward 3 | zf-C2H2 | Zinc finger, C2H2 type | 3.20E-06 |
| 232 | 575983CD1 | 8 | 79 | | ubiquitin | Ubiquitin family | 7.90E-09 |
| 235 | 1989186CD1 | 447 | 752 | | HECT | HECT-domain (ubiquitin-transferase). | 5.70E-130 |
| 235 | 1989186CD1 | 289 | 318 | | WW | WW domain | 3.00E-16 |
| 238 | 420527.25 | 924 | 1871 | forward 3 | pkinase | Eukaryotic protein kinase domain | 5.90E-79 |
| 239 | 998034.3 | 931 | 1152 | forward 1 | transcript_fac2 | Transcription factor TFIIB repeat | 5.80E-19 |
| 240 | 474165.26 | 244 | 465 | forward 1 | PWI | PWI domain | 2.60E-41 |
| 242 | 697785CD1 | 22 | 126 | | Gal-bind_lecti | Vertebrate galactoside-binding lectins | 2.90E-65 |
| 243 | 346209.3 | 285 | 2861 | forward 3 | Myosin_tail | Myosin tail | 2.00E-181 |
| 245 | 167772CD1 | 1 | 61 | | metalthio | Metallothionein | 2.20E-23 |
| 247 | 2514988CD1 | 2 | 284 | | Apolipoprotein | Apolipoprotein A1/A4/E family | 9.20E-144 |
| 248 | 481231.16 | 77 | 823 | forward 2 | Apolipoprotein | Apolipoprotein A1/A4/E family | 2.90E-123 |
| 249 | 481231.17 | 829 | 1599 | forward 1 | Apolipoprotein | Apolipoprotein A1/A4/E family | 2.20E-130 |
| 249 | 481231.17 | 216 | 986 | forward 3 | Apolipoprotein | Apolipoprotein A1/A4/E family | 1.60E-103 |
| 250 | 1045853.2 | 955 | 1713 | forward 1 | NAD_Gly3P_ | NAD-dependent glycerol-3-phosphate dehydrogenase | 2.00E-11 |
| 250 | 1045853.2 | 1889 | 2413 | forward 2 | transport_prot | Serum albumin family | 1.20E-89 |
| 251 | 336615.1 | 86 | 874 | forward 2 | Tub | Tub family | 3.00E-195 |
| 254 | 1081605.3 | 177 | 365 | forward 3 | KRAB | KRAB box | 4.10E-29 |
| 254 | 1081605.3 | 2649 | 2717 | forward 3 | zf-C2H2 | Zinc finger, C2H2 type | 3.90E-08 |
| 256 | 480169.76 | 337 | 453 | forward 1 | WD40 | WD domain, G-beta repeat | 2.80E-07 |
| 260 | 2993696CD1 | 30 | 636 | | HSP70 | Hsp70 protein | 0.00E+00 |
| 266 | 253783.3 | 976 | 1185 | forward 1 | rrm | RNA recognition motif, (a.k.a. RRM, RBD, or RNP domain) | 6.40E-21 |
| 266 | 253783.3 | 976 | 1185 | forward 1 | rrm | RNA recognition motif, (a.k.a. RRM, RBD, or RNP domain) | 6.40E-21 |
| 268 | 902559.1 | 733 | 1191 | forward 1 | Furin-like | Furin-like cysteine rich region | 1.70E-97 |
| 268 | 902559.1 | 358 | 732 | forward 1 | Recep_L_dom | Receptor L domain | 6.50E-60 |
| 268 | 902559.1 | 2238 | 2996 | forward 3 | pkinase | Eukaryotic protein kinase domain | 3.20E-61 |
| 272 | 2757583CD1 | 1 | 61 | | metalthio | Metallothionein | 1.20E-24 |
| 275 | 1508254CD1 | 16 | 463 | | hexokinase | Hexokinase | 0.00E+00 |
| 278 | 2457215CD1 | 299 | 364 | | rrm | RNA recognition motif, (a.k.a. RRM, RBD, or RNP domain) | 8.40E-16 |
| 285 | 1427459CD1 | 22 | 60 | | zf-C3HC4 | Zinc finger, C3HC4 type (RING finger) | 5.60E-14 |
| 288 | 241291.28 | 3067 | 3267 | forward 1 | FYVE | FYVE zinc finger | 9.30E-21 |
| 291 | 3993708CD1 | 2 | 42 | | Thymosin | Thymosin beta-4 family | 1.80E-24 |
| 292 | 1000133.12 | 76 | 198 | forward 1 | Thymosin | Thymosin beta-4 family | 1.80E-24 |
| 298 | 898779CD1 | 136 | 239 | | Gal-bind_lecti | Vertebrate galactoside-binding lectins | 3.80E-50 |
| 304 | 348082.7 | 686 | 946 | forward 2 | PDZ | PDZ domain (Also known as DHR or GLGF). | 1.20E-19 |
| 305 | 1097910.1 | 53 | 835 | forward 2 | p450 | Cytochrome P450 | 4.60E-107 |
| 311 | 2253717CD1 | 48 | 141 | | FKBP | FKBP-type peptidyl-prolyl cis-trans isomerases | 1.40E-27 |
| 318 | 2477616CD1 | 11 | 133 | | NTF2 | Nuclear transport factor 2 (NTF2) domain | 5.30E-67 |
| 318 | 2477616CD1 | 342 | 402 | | rrm | RNA recognition motif, (a.k.a. RRM, RBD, or RNP domain) | 1.70E-12 |
| 319 | 360532.1 | 574 | 660 | forward 1 | efhand | EF hand | 3.00E-08 |
| 320 | 360532.9 | 473 | 559 | forward 2 | efhand | EF hand | 3.00E-08 |
| 322 | 478620.53 | 924 | 1163 | forward 3 | rrm | RNA recognition motif, (a.k.a. RRM, RBD, or RNP domain) | 1.10E-17 |
| 322 | 478620.53 | 1329 | 1424 | forward 3 | zf-RanBP | Zn-finger in Ran binding protein and others. | 1.50E-11 |

TABLE 4-continued

| SEQ ID NO: | TEMPLATE II | START | STOP | FRAME | Pfam ID | Pfam Description | E-value |
|---|---|---|---|---|---|---|---|
| 325 | 474588.21 | 2263 | 2460 | forward 1 | rrm | RNA recognition motif, (a.k.a. RRM, RBD, or RNP domain) | 9.20E−21 |
| 325 | 474588.21 | 1863 | 2075 | forward 3 | rrm | RNA recognition motif, (a.k.a. RRM, RBD, or RNP domain) | 6.90E−09 |
| 333 | 4005778CD1 | 13 | 169 | | ferritin | Ferritins | 6.90E−99 |
| 334 | 995575.17 | 439 | 1260 | forward 1 | NAP_family | Nucleosome assembly protein (NAP) | 8.80E−191 |
| 336 | 863406CD1 | 15 | 717 | | Cullin | Cullin family | 2.50E−234 |
| 337 | 413864.17 | 910 | 1008 | forward 1 | ank | Ank repeat | 2.30E−07 |
| 338 | 350106.16 | 574 | 1905 | forward 1 | GLFV_dehydr | Glutamate/Leucine/Phenylalanine/Valine dehydrogenase | 1.70E−200 |
| 341 | 255824.39 | 568 | 1317 | forward 1 | glycolytic_enz | Fructose-bisphosphate aldolase class-I | 9.60E−192 |
| 341 | 255824.39 | 276 | 581 | forward 3 | glycolytic_enz | Fructose-bisphosphate aldolase class-I | 2.70E−65 |
| 343 | 2706606CD1 | 15 | 364 | | glycolytic_enz | Fructose-bisphosphate aldolase class-I | 7.60E−270 |
| 345 | 1039889.26 | 515 | 1279 | forward 2 | actin | Actin | 3.90E−190 |
| 345 | 1039889.26 | 117 | 491 | forward 3 | actin | Actin | 2.40E−89 |
| 346 | 481480.7 | 112 | 348 | forward 1 | ICE_p10 | ICE-like protease (caspase) p10 domain | 6.40E−41 |
| 351 | 331104.2 | 481 | 2220 | forward 1 | PAL | Phenylalanine and histidine ammonia-lyases | 0.00E+00 |
| 352 | 348390.2 | 108 | 413 | forward 3 | actin | Actin | 9.40E−59 |
| 357 | 364726.10 | 333 | 647 | forward 3 | Guanylate_kin | Guanylate kinase | 7.10E−17 |
| 358 | 364726.12 | 2317 | 2631 | forward 1 | Guanylate_kin | Guanylate kinase | 5.60E−10 |
| 358 | 364726.12 | 223 | 483 | forward 1 | PDZ | PDZ domain (Also known as DHR or GLGF). | 9.20E−20 |
| 360 | 1505038CD1 | 54 | 98 | | kazal | Kazal-type serine protease inhibitor domain | 7.20E−12 |
| 367 | 1719478CD1 | 1177 | 1445 | | ion_trans | Ion transport protein | 2.00E−100 |
| 368 | 351157.2 | 3 | 134 | forward 3 | homeobox | Homeobox domain | 6.60E−13 |
| 370 | 088957CD1 | 28 | 202 | | transport_prot | Serum albumin family | 1.20E−89 |
| 373 | 1102297.22 | 1354 | 2481 | forward 1 | actin | Actin | 1.70E−286 |
| 375 | 171495.1 | 67 | 237 | forward 1 | homeobox | Homeobox domain | 4.10E−34 |
| 376 | 242010.43 | 2 | 1267 | forward 2 | HSP70 | Hsp70 protein | 5.00E−129 |
| 378 | 5834958CD1 | 36 | 575 | | SNF | Sodium:neurotransmitter symporter family | 0.00E+00 |
| 384 | 1100320.4 | 237 | 503 | forward 3 | Dynein_light | Dynein light chain type I | 1.10E−62 |
| 386 | 246727.17 | 469 | 678 | forward 1 | rrm | RNA recognition motif, (a.k.a. RRM, RBD, or RNP domain) | 1.00E−13 |
| 388 | 1102322.18 | 5 | 751 | forward 2 | HSP70 | Hsp70 protein | 3.80E−05 |
| 390 | 2070610CD1 | 39 | 412 | | serpin | Serpins (serine protease inhibitors) | 2.70E−194 |
| 392 | 1326902.13 | 270 | 473 | forward 3 | annexin | Annexin | 5.20E−18 |
| 393 | 1326902.6 | 919 | 1122 | forward 1 | annexin | Annexin | 5.20E−18 |
| 393 | 1326902.6 | 459 | 662 | forward 3 | annexin | Annexin | 1.10E−24 |
| 394 | 013521.16 | 486 | 734 | forward 3 | PH | PH domain | 1.50E−09 |

TABLE 5

| SEQ ID NO: | TEMPLATE II | START | STOP | FRAME | HIT TYPE |
|---|---|---|---|---|---|
| 6 | 3201389CD1 | 26 | 52 | | TM |
| 6 | 3201389CD1 | 185 | 210 | | TM |
| 6 | 3201389CD1 | 145 | 171 | | SP |
| 9 | 1102322.16 | 127 | 219 | forward 1 | SP |
| 9 | 1102322.16 | 313 | 396 | forward 1 | SP |
| 12 | 978222.4 | 533 | 625 | forward 2 | SP |
| 13 | 978222.5 | 660 | 737 | forward 3 | TM |
| 15 | 1720920CD1 | 2220 | 2246 | | TM |
| 15 | 1720920CD1 | 2222 | 2248 | | SP |
| 15 | 1720920CD1 | 1 | 30 | | SP |
| 17 | 1857017CD1 | 10 | 36 | | TM |
| 33 | 3393861CD1 | 1 | 29 | | SP |
| 35 | 2517374CD1 | 1 | 34 | | SP |
| 38 | 237416.14 | 570 | 665 | forward 3 | SP |
| 38 | 237416.14 | 863 | 940 | forward 2 | TM |
| 40 | 1269631CD1 | 1 | 28 | | SP |
| 50 | 2989375CD1 | 23 | 49 | | SP |
| 54 | 978740.3 | 3103 | 3186 | forward 1 | TM |
| 54 | 978740.3 | 652 | 741 | forward 1 | SP |
| 55 | 400197.1 | 244 | 321 | forward 1 | TM |
| 60 | 348072.5 | 243 | 323 | forward 3 | SP |
| 60 | 348072.5 | 780 | 881 | forward 3 | SP |
| 60 | 348072.5 | 132 | 221 | forward 3 | SP |
| 60 | 348072.5 | 1659 | 1751 | forward 3 | SP |
| 60 | 348072.5 | 10 | 99 | forward 1 | SP |
| 68 | 088564CD1 | 1 | 26 | | SP |
| 69 | 040429.1 | 656 | 739 | forward 2 | TM |
| 69 | 040429.1 | 93 | 179 | forward 3 | SP |
| 70 | 407096.2 | 1083 | 1157 | forward 3 | TM |
| 70 | 407096.2 | 1099 | 1179 | forward 1 | SP |
| 83 | 1434821CD1 | 1 | 26 | | SP |
| 84 | 289671.27 | 1132 | 1221 | forward 1 | SP |
| 84 | 289671.27 | 1298 | 1375 | forward 2 | SP |
| 88 | 464689.40 | 281 | 361 | forward 2 | SP |
| 89 | 155943.1 | 964 | 1047 | forward 1 | SP |
| 89 | 155943.1 | 995 | 1069 | forward 2 | TM |
| 95 | 1273641CD1 | 136 | 161 | | SP |
| 98 | 347055.4 | 1769 | 1864 | forward 2 | SP |
| 100 | 898899.32 | 242 | 337 | forward 2 | SP |
| 109 | 1448817CD1 | 1 | 31 | | SP |
| 111 | 332521.1 | 397 | 483 | forward 1 | SP |
| 112 | 225080.16 | 2387 | 2488 | forward 2 | SP |
| 114 | 995529.7 | 275 | 358 | forward 2 | SP |
| 115 | 995529.8 | 285 | 368 | forward 3 | SP |
| 115 | 995529.8 | 1605 | 1688 | forward 3 | TM |
| 116 | 201851.1 | 3954 | 4034 | forward 3 | TM |
| 118 | 059509CD1 | 3 | 32 | | SP |
| 127 | 1459432CD1 | 41 | 66 | | TM |
| 130 | 516300CD1 | 1 | 28 | | SP |
| 147 | 988653.1 | 1080 | 1166 | forward 3 | SP |
| 147 | 988653.1 | 3422 | 3502 | forward 2 | TM |
| 150 | 236196.3 | 563 | 643 | forward 2 | TM |
| 150 | 236196.3 | 754 | 834 | forward 1 | SP |
| 150 | 236196.3 | 851 | 928 | forward 2 | TM |
| 154 | 014284CD1 | 1 | 28 | | SP |
| 159 | 978276.8 | 2041 | 2115 | forward 1 | TM |
| 159 | 978276.8 | 2041 | 2115 | forward 1 | SP |
| 160 | 405844.21 | 559 | 651 | forward 1 | SP |

TABLE 5-continued

| SEQ ID NO: | TEMPLATE II | START | STOP | FRAME | HIT TYPE |
|---|---|---|---|---|---|
| 161 | 405844.22 | 649 | 741 | forward 1 | SP |
| 165 | 2023119CD1 | 23 | 50 | | TM |
| 165 | 2023119CD1 | 562 | 587 | | TM |
| 166 | 1000084.27 | 4622 | 4705 | forward 2 | SP |
| 166 | 1000084.27 | 309 | 410 | forward 3 | SP |
| 166 | 1000084.27 | 1089 | 1169 | forward 3 | SP |
| 166 | 1000084.27 | 4170 | 4259 | forward 3 | SP |
| 166 | 1000084.27 | 4040 | 4123 | forward 2 | SP |
| 166 | 1000084.27 | 4138 | 4227 | forward 1 | SP |
| 167 | 220134.1 | 2246 | 2326 | forward 2 | TM |
| 168 | 216331.1 | 1465 | 1551 | forward 1 | TM |
| 170 | 382906.16 | 155 | 238 | forward 2 | SP |
| 171 | 331306.1 | 273 | 350 | forward 3 | TM |
| 171 | 331306.1 | 2517 | 2594 | forward 3 | TM |
| 171 | 331306.1 | 897 | 974 | forward 3 | TM |
| 171 | 331306.1 | 576 | 659 | forward 3 | TM |
| 172 | 1094829.20 | 1156 | 1242 | forward 1 | SP |
| 172 | 1094829.20 | 673 | 756 | forward 1 | SP |
| 173 | 1094829.38 | 1468 | 1554 | forward 1 | SP |
| 173 | 1094829.38 | 985 | 1068 | forward 1 | SP |
| 174 | 1135580.4 | 4037 | 4120 | forward 2 | TM |
| 174 | 1135580.4 | 4599 | 4685 | forward 3 | SP |
| 174 | 1135580.4 | 4492 | 4581 | forward 1 | SP |
| 174 | 1135580.4 | 3367 | 3453 | forward 1 | SP |
| 174 | 1135580.4 | 1701 | 1790 | forward 3 | SP |
| 174 | 1135580.4 | 4103 | 4183 | forward 2 | SP |
| 175 | 196623.3 | 659 | 739 | forward 2 | SP |
| 176 | 048488.32 | 2758 | 2835 | forward 1 | TM |
| 182 | 461707.40 | 185 | 268 | forward 2 | SP |
| 185 | 474372.7 | 2106 | 2198 | forward 3 | SP |
| 185 | 474372.7 | 2084 | 2164 | forward 2 | TM |
| 189 | 048612.13 | 663 | 743 | forward 3 | SP |
| 192 | 522433CD1 | 1 | 29 | | SP |
| 198 | 1326983.14 | 4115 | 4198 | forward 2 | TM |
| 198 | 1326983.14 | 2343 | 2423 | forward 3 | TM |
| 198 | 1326983.14 | 114 | 197 | forward 3 | TM |
| 198 | 1326983.14 | 2467 | 2550 | forward 1 | TM |
| 198 | 1326983.14 | 1547 | 1624 | forward 2 | TM |
| 198 | 1326983.14 | 1406 | 1483 | forward 2 | TM |
| 198 | 1326983.14 | 4115 | 4198 | forward 2 | TM |
| 198 | 1326983.14 | 2343 | 2423 | forward 3 | TM |
| 198 | 1326983.14 | 114 | 197 | forward 3 | TM |
| 198 | 1326983.14 | 2467 | 2550 | forward 1 | TM |
| 198 | 1326983.14 | 1547 | 1624 | forward 2 | TM |
| 198 | 1326983.14 | 1406 | 1483 | forward 2 | TM |
| 200 | 2120743CD1 | 295 | 323 | | TM |
| 200 | 2120743CD1 | 189 | 219 | | SP |
| 200 | 2120743CD1 | 344 | 374 | | SP |
| 200 | 2120743CD1 | 87 | 113 | | SP |
| 211 | 1097380.1 | 864 | 962 | forward 3 | SP |
| 211 | 1097380.1 | 1360 | 1440 | forward 1 | TM |
| 214 | 253987.16 | 512 | 592 | forward 2 | TM |
| 215 | 344553.1 | 3343 | 3420 | forward 1 | TM |
| 216 | 410785.1 | 2055 | 2141 | forward 3 | TM |
| 216 | 410785.1 | 4411 | 4494 | forward 1 | TM |
| 216 | 410785.1 | 997 | 1080 | forward 1 | SP |
| 216 | 410785.1 | 1383 | 1469 | forward 3 | TM |
| 216 | 410785.1 | 4554 | 4637 | forward 3 | TM |
| 217 | 237623.6 | 24 | 104 | forward 3 | SP |
| 219 | 1099500.15 | 10 | 102 | forward 1 | TM |
| 222 | 2278688CD1 | 1 | 39 | | SP |
| 223 | 380283.1 | 6996 | 7079 | forward 3 | TM |
| 223 | 380283.1 | 73 | 153 | forward 1 | SP |
| 223 | 380283.1 | 3502 | 3591 | forward 1 | SP |
| 223 | 380283.1 | 7939 | 8019 | forward 1 | TM |
| 223 | 380283.1 | 6383 | 6460 | forward 2 | TM |
| 223 | 380283.1 | 6479 | 6562 | forward 2 | TM |
| 223 | 380283.1 | 6083 | 6175 | forward 2 | SP |
| 228 | 3478236CD1 | 1 | 26 | | SP |
| 228 | 3478236CD1 | 191 | 217 | | SP |
| 229 | 147541.17 | 4089 | 4178 | forward 3 | SP |
| 233 | 413268.6 | 4424 | 4513 | forward 2 | SP |
| 233 | 413268.6 | 3689 | 3772 | forward 2 | SP |
| 233 | 413268.6 | 893 | 979 | forward 2 | SP |
| 238 | 420527.25 | 660 | 737 | forward 3 | TM |
| 238 | 420527.25 | 662 | 742 | forward 2 | TM |
| 240 | 474165.26 | 2961 | 3074 | forward 3 | SP |
| 240 | 474165.26 | 3015 | 3098 | forward 3 | TM |
| 243 | 346209.3 | 3564 | 3650 | forward 3 | SP |
| 249 | 481231.17 | 1760 | 1846 | forward 2 | SP |
| 250 | 1045853.2 | 1238 | 1324 | forward 2 | SP |
| 253 | 085282.1 | 339 | 422 | forward 3 | TM |
| 258 | 2636043CD1 | 117 | 143 | | TM |
| 262 | 240518.34 | 1591 | 1701 | forward 1 | SP |
| 266 | 253783.3 | 1181 | 1264 | forward 2 | SP |
| 266 | 253783.3 | 1181 | 1264 | forward 2 | SP |
| 268 | 902559.1 | 4378 | 4464 | forward 1 | SP |
| 268 | 902559.1 | 512 | 607 | forward 2 | SP |
| 276 | 474691.3 | 1030 | 1107 | forward 1 | SP |
| 276 | 474691.3 | 3859 | 3945 | forward 1 | TM |
| 276 | 474691.3 | 3957 | 4040 | forward 3 | TM |
| 283 | 1040190.3 | 81 | 164 | forward 3 | SP |
| 287 | 1095604.1 | 182 | 262 | forward 3 | SP |
| 288 | 241291.28 | 10604 | 10684 | forward 2 | SP |
| 288 | 241291.28 | 73 | 153 | forward 1 | SP |
| 288 | 241291.28 | 4075 | 4176 | forward 1 | SP |
| 288 | 241291.28 | 11296 | 11373 | forward 1 | TM |
| 288 | 241291.28 | 10088 | 10168 | forward 2 | SP |
| 288 | 241291.28 | 10841 | 10921 | forward 2 | TM |
| 288 | 241291.28 | 3228 | 3311 | forward 3 | SP |
| 288 | 241291.28 | 655 | 738 | forward 1 | SP |
| 294 | 400253.5 | 1917 | 1994 | forward 3 | SP |
| 294 | 400253.5 | 748 | 828 | forward 1 | SP |
| 294 | 400253.5 | 1063 | 1152 | forward 1 | SP |
| 294 | 400253.5 | 1963 | 2040 | forward 1 | SP |
| 294 | 400253.5 | 213 | 293 | forward 3 | SP |
| 305 | 1097910.1 | 204 | 284 | forward 3 | SP |
| 305 | 1097910.1 | 582 | 662 | forward 3 | SP |
| 306 | 246841.1 | 2036 | 2137 | forward 2 | SP |
| 307 | 351241.1 | 139 | 219 | forward 1 | TM |
| 311 | 2253717CD1 | 1 | 27 | | SP |
| 315 | 232818.15 | 204 | 290 | forward 3 | SP |
| 315 | 232818.15 | 782 | 862 | forward 2 | TM |
| 322 | 478620.53 | 306 | 386 | forward 3 | SP |
| 322 | 478620.53 | 227 | 313 | forward 2 | SP |
| 322 | 478620.53 | 1135 | 1227 | forward 1 | SP |
| 325 | 474588.21 | 1315 | 1392 | forward 1 | TM |
| 328 | 347796.7 | 2467 | 2550 | forward 1 | TM |
| 334 | 995575.17 | 1691 | 1771 | forward 2 | SP |
| 334 | 995575.17 | 1641 | 1727 | forward 3 | TM |
| 334 | 995575.17 | 3283 | 3363 | forward 1 | TM |
| 337 | 413864.17 | 1178 | 1258 | forward 2 | TM |
| 337 | 413864.17 | 1159 | 1239 | forward 1 | TM |
| 350 | 235447.5 | 5478 | 5558 | forward 3 | TM |
| 351 | 331104.2 | 2656 | 2754 | forward 1 | SP |
| 356 | 480375.28 | 54 | 134 | forward 3 | TM |
| 356 | 480375.28 | 50 | 130 | forward 1 | TM |
| 356 | 480375.28 | 54 | 134 | forward 3 | TM |
| 356 | 480375.28 | 50 | 130 | forward 2 | TM |
| 357 | 364726.10 | 1380 | 1466 | forward 3 | SP |
| 358 | 364726.12 | 4106 | 4183 | forward 2 | TM |
| 361 | 903508.12 | 2552 | 2632 | forward 2 | TM |
| 363 | 346716.21c | 529 | 609 | forward 1 | SP |
| 367 | 1719478CD1 | 1734 | 1760 | | TM |
| 367 | 1719478CD1 | 1631 | 1656 | | TM |
| 367 | 1719478CD1 | 380 | 407 | | TM |
| 367 | 1719478CD1 | 1627 | 1653 | | SP |
| 367 | 1719478CD1 | 939 | 967 | | SP |
| 371 | 980446.1 | 353 | 427 | forward 2 | TM |
| 373 | 1102297.22 | 173 | 256 | forward 2 | SP |
| 373 | 1102297.22 | 1838 | 1924 | forward 2 | SP |
| 374 | 215112.1 | 383 | 466 | forward 2 | TM |
| 375 | 171495.1 | 1008 | 1097 | forward 3 | TM |
| 378 | 5834958CD1 | 408 | 435 | | TM |
| 378 | 5834958CD1 | 488 | 518 | | SP |
| 378 | 5834958CD1 | 373 | 402 | | SP |
| 380 | 333840.1 | 1873 | 1950 | forward 1 | TM |
| 380 | 333840.1 | 2180 | 2269 | forward 2 | SP |
| 380 | 333840.1 | 1818 | 1901 | forward 3 | SP |
| 386 | 246727.17 | 2262 | 2348 | forward 3 | SP |
| 388 | 1102322.18 | 155 | 247 | forward 2 | SP |

TABLE 5-continued

| SEQ ID NO: | TEMPLATE II | START | STOP | FRAME | HIT TYPE |
|---|---|---|---|---|---|
| 397 | 372647.1 | 215 | 295 | forward 2 | TM |
| 399 | 209279.1 | 661 | 741 | forward 1 | SP |

TABLE 6

| SEQ ID NO: | TEMPLATE I | CLONE ID | START | STOP |
|---|---|---|---|---|
| 1 | 220060.4 | 26474 | 1 | 274 |
| 2 | 016238.1 | 60123 | 1 | 218 |
| 3 | 1266683.1 | 63038 | 1 | 212 |
| 4 | 129384.1c | 72713 | 225 | 440 |
| 5 | 3201389CB1 | 85606 | 1 | 2537 |
| 7 | 086390CB1 | 86390 | 23 | 647 |
| 9 | 1102322.16 | 118501 | 280 | 852 |
| 10 | 1545176CB1 | 118501 | 36 | 2295 |
| 12 | 978222.4 | 121785 | 764 | 1167 |
| 13 | 978222.5 | 121785 | 92 | 636 |
| 14 | 1720920CB1 | 136073 | 71 | 7699 |
| 16 | 1857017CB1 | 160822 | 334 | 4843 |
| 16 | 1857017CB1 | 3493710 | 334 | 4843 |
| 18 | 2114865CB1 | 167081 | 369 | 1949 |
| 20 | 2700132CB1 | 172023 | 70 | 10502 |
| 20 | 2700132CB1 | 2470485 | 70 | 10502 |
| 22 | 238349.2 | 211389 | 4294 | 4448 |
| 23 | 238349.4c | 211389 | 1 | 110 |
| 24 | 402917.3c | 237027 | 428 | 858 |
| 25 | 406330.1 | 259054 | 482 | 1179 |
| 26 | 2516070CB1 | 271299 | 757 | 1693 |
| 26 | 2516070CB1 | 2517386 | 757 | 1693 |
| 28 | 167507CB1 | 279249 | 1 | 1656 |
| 30 | 3860413CB1 | 279898 | 1 | 617 |
| 30 | 3860413CB1 | 3121871 | 1 | 617 |
| 32 | 3393861CB1 | 280932 | 28 | 1656 |
| 34 | 2517374CB1 | 293477 | 16 | 868 |
| 36 | 030850.7 | 311346 | 1 | 483 |
| 37 | 237416.12c | 318486 | 1 | 567 |
| 38 | 237416.14 | 318486 | 93 | 616 |
| 39 | 1269631CB1 | 341884 | 118 | 6985 |
| 41 | 961189CB1 | 348143 | 25 | 2192 |
| 43 | 246946.1 | 388964 | 0 | 394 |
| 44 | 017958.1 | 389362 | 1 | 259 |
| 45 | 985556.1 | 407032 | 906 | 1234 |
| 46 | 476301CB1 | 408886 | 1 | 2523 |
| 48 | 996427.2 | 419492 | 801 | 2458 |
| 49 | 2989375CB1 | 437481 | 1 | 902 |
| 51 | 236359.2 | 442723 | 112 | 618 |
| 52 | 011112.1C | 443991 | 12 | 342 |
| 53 | 198268.1 | 450856 | 297 | 854 |
| 54 | 978740.3 | 452321 | 2764 | 3535 |
| 55 | 400197.1 | 454839 | 1 | 1025 |
| 56 | 235687.5c | 459372 | −27 | 410 |
| 57 | 2797839CB1 | 460779 | 1 | 2650 |
| 59 | 978690.6 | 462069 | 164 | 864 |
| 60 | 348072.5 | 480791 | 1960 | 2765 |
| 61 | 085596CB1 | 481402 | 119 | 2070 |
| 63 | 103917CB1 | 510056 | 39 | 1674 |
| 65 | 3603037CB1 | 511448 | 1 | 2979 |
| 67 | 088564CB1 | 560115 | 1 | 823 |
| 69 | 040429.1 | 604019 | 736 | 1087 |
| 70 | 407096.2 | 630625 | 2268 | 3868 |
| 71 | 209265.54 | 669498 | 2155 | 2752 |
| 72 | 701484CB1 | 701484 | −188 | 2308 |
| 74 | 251859.2 | 758192 | 654 | 3262 |
| 75 | 3766715CB1 | 773154 | 1666 | 5251 |
| 77 | 2049950CB1 | 818192 | 347 | 3779 |
| 79 | 231588.6c | 818192 | 1 | 557 |
| 80 | 152298.2 | 872017 | 84 | 834 |
| 81 | 199507.1 | 891322 | 1 | 342 |
| 82 | 1434821CB1 | 963536 | −298 | 620 |
| 84 | 289671.27 | 970905 | 2307 | 2723 |
| 85 | 1282225CB1 | 990375 | 130 | 657 |
| 87 | 263336.57 | 1213932 | 4 | 324 |
| 88 | 464689.40 | 1259841 | 1 | 897 |
| 89 | 155943.1 | 1272483 | 339 | 840 |
| 90 | 243794.19c | 1306814 | 834 | 1050 |
| 91 | 243794.23 | 1306814 | 284 | 522 |
| 92 | 159309CB1 | 1308112 | 21 | 3061 |
| 94 | 1273641CB1 | 1315663 | 127 | 1425 |
| 96 | 403717.1 | 1316801 | 1 | 773 |
| 97 | 047593.1 | 1326255 | 1 | 794 |
| 98 | 347055.4 | 1368834 | 3159 | 3550 |
| 99 | 898899.11 | 1379063 | 1046 | 1377 |
| 100 | 898899.32 | 1379063 | 2052 | 2524 |
| 101 | 2047630CB1 | 1381654 | 180 | 2123 |
| 103 | 1039889.8 | 1395143 | 609 | 994 |
| 104 | 1272969CB1 | 1435374 | 2984 | 4434 |
| 106 | 282397.85c | 1441245 | 2665 | 6228 |
| 107 | 282397.94 | 1441245 | 1 | 622 |
| 108 | 1448817CB1 | 1448718 | 15 | 1535 |
| 110 | 1100769.2 | 1454436 | 35 | 697 |
| 111 | 332521.1 | 1457424 | 871 | 1424 |
| 112 | 225080.16 | 1457718 | 4047 | 4330 |
| 113 | 334851.5 | 1464613 | 757 | 1127 |
| 114 | 995529.7 | 1468660 | 445 | 843 |
| 115 | 995529.8 | 1468660 | 938 | 1169 |
| 116 | 201851.1 | 1482116 | 3045 | 3958 |
| 117 | 059509CB1 | 1495382 | 16 | 1623 |
| 119 | 481231.14 | 1500245 | 1 | 406 |
| 120 | 280276CB1 | 1511658 | 112 | 2332 |
| 122 | 4675668CB1 | 1519431 | 17 | 1723 |
| 124 | 153825.1 | 1519683 | 560 | 1056 |
| 125 | 403484.2c | 1522880 | 1695 | 2180 |
| 126 | 1459432CB1 | 1522880 | 1 | 2144 |
| 128 | 1096583.1 | 1530595 | 233 | 424 |
| 129 | 516300CB1 | 1559665 | 1 | 763 |
| 131 | 627856CB1 | 1559756 | 550 | 1997 |
| 133 | 1823159CB1 | 1560906 | 1 | 3471 |
| 135 | 232567.4 | 1577614 | 513 | 1142 |
| 136 | 218419.1 | 1616783 | 1 | 184 |
| 137 | 1630551CB1 | 1619292 | 2 | 1229 |
| 139 | 360961.19 | 1619980 | 1208 | 1470 |
| 140 | 809809CB1 | 1623214 | 1 | 2116 |
| 142 | 2558815CB1 | 1630990 | −4 | 2431 |
| 144 | 242010.16 | 1696224 | 1767 | 2352 |
| 145 | 1678695CB1 | 1696224 | −761 | 1690 |
| 147 | 988653.1 | 1705208 | 1702 | 2382 |
| 148 | 1250434CB1 | 1711151 | 46 | 3277 |
| 150 | 236196.3 | 1732221 | 1 | 524 |
| 151 | 442308.1 | 1756875 | 1 | 375 |
| 152 | 060957.1 | 1786554 | 1 | 597 |
| 153 | 014284CB1 | 1822716 | 2 | 1900 |
| 155 | 1095192.1 | 1833362 | 247 | 684 |
| 156 | 233003.20 | 1834236 | 1 | 552 |
| 157 | 1911808CB1 | 1834236 | 88 | 3722 |
| 159 | 978276.8 | 1838114 | 3037 | 3497 |
| 160 | 405844.21 | 1845046 | 341 | 938 |
| 161 | 405844.22 | 1845046 | 925 | 1484 |
| 162 | 2705515CB1 | 1846209 | 1 | 2256 |
| 164 | 2023119CB1 | 1846463 | 34 | 3324 |
| 166 | 1000084.27 | 1861456 | 1583 | 1991 |
| 166 | 1000084.27 | 3679667 | 1646 | 2138 |
| 167 | 220134.1 | 1867614 | 477 | 2949 |
| 168 | 216331.1 | 1869130 | 1226 | 1976 |
| 169 | 206044.1 | 1871340 | 347 | 580 |
| 170 | 382906.16 | 1874037 | 54 | 505 |
| 171 | 331306.1 | 1874307 | 1576 | 2007 |
| 172 | 1094829.20 | 1890576 | 1268 | 1652 |
| 173 | 1094829.38 | 1890576 | 566 | 1023 |
| 174 | 1135580.4 | 1890791 | 3964 | 5687 |
| 175 | 196623.3 | 1920215 | 1299 | 1746 |
| 176 | 048488.32 | 1922468 | 2741 | 3572 |
| 177 | 2767012CB1 | 1926883 | 17 | 1485 |
| 179 | 1651724CB1 | 1930235 | 41 | 2059 |
| 181 | 206397.1 | 1956982 | 1 | 237 |
| 182 | 461707.40 | 1958226 | 353 | 701 |
| 183 | 2706645CB1 | 1963081 | 13 | 975 |
| 185 | 474372.7 | 1966517 | 2037 | 2539 |
| 186 | 3592543CB1 | 1969563 | 1 | 2198 |

TABLE 6-continued

| SEQ ID NO: | TEMPLATE I | CLONE ID | START | STOP |
|---|---|---|---|---|
| 188 | 048612.12c | 1975268 | 872 | 1420 |
| 189 | 048612.13 | 1975268 | 2418 | 2666 |
| 190 | 245259.16 | 1998269 | 1787 | 2319 |
| 191 | 522433CB1 | 2042056 | 15 | 1251 |
| 193 | 1040667.43 | 2046717 | 1 | 372 |
| 194 | 2048551CB1 | 2048551 | 1 | 558 |
| 196 | 1969731CB1 | 2055569 | 3 | 3038 |
| 198 | 1326983.14 | 2055867 | 4029 | 4749 |
| 199 | 2120743CB1 | 2120743 | 1 | 3934 |
| 201 | 3551330CB1 | 2121863 | 334 | 770 |
| 203 | 1440032CB1 | 2123516 | 622 | 2962 |
| 205 | 1000133.1 | 2132285 | 137 | 609 |
| 206 | 4020439CB1 | 2132774 | 260 | 700 |
| 208 | 2507087CB1 | 2160794 | 1 | 4241 |
| 210 | 239996.1 | 2195427 | 127 | 589 |
| 211 | 1097380.1 | 2201708 | 43 | 967 |
| 212 | 021524.2c | 2208780 | 3082 | 3404 |
| 213 | 021524.9 | 2208780 | 1272 | 1527 |
| 214 | 253987.16 | 2232658 | 1 | 360 |
| 215 | 344553.1 | 2234853 | 2584 | 3171 |
| 216 | 410785.1 | 2241825 | 4508 | 4883 |
| 217 | 237623.6 | 2242817 | 1 | 451 |
| 218 | 076047.1 | 2252107 | 1 | 392 |
| 219 | 1099500.15 | 2273944 | 1107 | 1756 |
| 220 | 1099500.18 | 2273944 | 2360 | 2777 |
| 221 | 2278688CB1 | 2278688 | 1233 | 5389 |
| 223 | 380283.1 | 2293496 | 7546 | 7928 |
| 224 | 1720847CB1 | 2311213 | 855 | 1844 |
| 226 | 333776.1c | 2343348 | 126 | 201 |
| 227 | 3478236CB1 | 2352645 | 1 | 1278 |
| 229 | 147541.17 | 2360580 | 1850 | 3484 |
| 230 | 331120.16c | 2365335 | 4150 | 4601 |
| 231 | 575983CB1 | 2382192 | 1 | 798 |
| 233 | 413268.6 | 2382195 | 2182 | 4148 |
| 234 | 1989186CB1 | 2383269 | 904 | 3033 |
| 236 | 337448.1c | 2394990 | 1 | 308 |
| 237 | 228304.19 | 2399162 | 636 | 1144 |
| 238 | 420527.25 | 2446289 | 248 | 2143 |
| 239 | 998034.3 | 2448149 | 377 | 3629 |
| 240 | 474165.26 | 2453558 | 105 | 560 |
| 241 | 697785CB1 | 2495131 | 233 | 770 |
| 243 | 346209.3 | 2511277 | 3331 | 3758 |
| 244 | 167772CB1 | 2513883 | 505 | 974 |
| 246 | 2514988CB1 | 2514988 | 199 | 1492 |
| 248 | 481231.16 | 2516070 | 57 | 461 |
| 249 | 481231.17 | 2516070 | 205 | 1661 |
| 249 | 481231.17 | 2516104 | 819 | 1661 |
| 249 | 481231.17 | 2516261 | 197 | 1659 |
| 249 | 481231.17 | 2516448 | 1395 | 1698 |
| 250 | 1045853.2 | 2517254 | 1874 | 3884 |
| 250 | 1045853.2 | 5398014 | 1874 | 3898 |
| 251 | 336615.1 | 2520894 | 1088 | 1325 |
| 252 | 1328423.2 | 2527879 | 423 | 938 |
| 253 | 085282.1 | 2545486 | 83 | 487 |
| 254 | 1081605.3 | 2550767 | 3196 | 3739 |
| 255 | 1053517.1 | 2579218 | 1 | 233 |
| 256 | 480169.76 | 2607921 | 716 | 2565 |
| 257 | 2636043CB1 | 2636043 | 98 | 1101 |
| 259 | 2993696CB1 | 2641522 | −8 | 2532 |
| 261 | 240518.21 | 2660756 | 1 | 333 |
| 262 | 240518.34 | 2660756 | 534 | 1026 |
| 263 | 001322.4c | 2663164 | 1069 | 3206 |
| 264 | 350502.3 | 2675232 | 39 | 440 |
| 265 | 350502.4c | 2675232 | 547 | 1016 |
| 266 | 253783.3 | 2695371 | 993 | 1843 |
| 267 | 085119.1 | 2708055 | 577 | 869 |
| 268 | 902559.1 | 2740665 | 5148 | 5635 |
| 269 | 4113161CB1 | 2756333 | 108 | 2295 |
| 271 | 2757583CB1 | 2757583 | 268 | 709 |
| 273 | 198317.1 | 2765271 | 29 | 881 |
| 274 | 1508254CB1 | 2769888 | 1363 | 4652 |
| 276 | 474691.3 | 2813255 | 820 | 1466 |
| 277 | 2457215CB1 | 2820337 | 1 | 3437 |
| 279 | 201395.4c | 2822027 | 4780 | 5689 |
| 280 | 233189.21 | 2825358 | 85 | 565 |
| 281 | 196606.6c | 2830828 | 1 | 566 |
| 282 | 196606.8c | 2830828 | 113 | 696 |
| 283 | 1040190.3 | 2831490 | 38 | 1110 |
| 284 | 1427459CB1 | 2860918 | −28 | 1364 |
| 286 | 480453.16c | 2879068 | 2710 | 3067 |
| 287 | 1095604.1 | 2884613 | 3 | 282 |
| 288 | 241291.28 | 2890336 | 2125 | 2463 |
| 289 | 230611.1 | 2891601 | 1 | 64 |
| 290 | 3993708CB1 | 2899419 | 59 | 633 |
| 292 | 1000133.12 | 2899419 | 13 | 307 |
| 293 | 400253.17c | 2912637 | 4051 | 4601 |
| 294 | 400253.5 | 2912637 | 238 | 742 |
| 295 | 030882CB1 | 2912830 | 67 | 443 |
| 297 | 898779CB1 | 2921194 | 294 | 1408 |
| 299 | 3727408CB1 | 2921991 | 4 | 532 |
| 301 | 984236.1c | 2925373 | 47 | 494 |
| 302 | 984236.2c | 2925373 | 223 | 494 |
| 303 | 348082.5 | 2929484 | 193 | 582 |
| 304 | 348082.7 | 2929484 | 516 | 980 |
| 305 | 1097910.1 | 2933775 | 389 | 886 |
| 306 | 246841.1 | 2953987 | 2907 | 3189 |
| 307 | 351241.1 | 2955163 | 312 | 757 |
| 308 | 2790762CB1 | 2956444 | 158 | 1221 |
| 310 | 2253717CB1 | 2957205 | 103 | 815 |
| 312 | 2655184CB1 | 2991027 | 401 | 1496 |
| 314 | 363000.9c | 2991027 | 1014 | 1447 |
| 315 | 232818.15 | 2992044 | 1069 | 1721 |
| 316 | 347781.10 | 2999855 | 576 | 937 |
| 317 | 2477616CB1 | 2999855 | 1 | 2835 |
| 319 | 360532.1 | 3026540 | 210 | 800 |
| 320 | 360532.9 | 3026540 | 79 | 1158 |
| 321 | 110245.1 | 3028719 | 1 | 396 |
| 322 | 478620.53 | 3038508 | 1447 | 1779 |
| 323 | 1813444CB1 | 3038508 | 7 | 1694 |
| 325 | 474588.21 | 3070625 | 1761 | 2181 |
| 326 | 407838.1 | 3074113 | 234 | 997 |
| 327 | 994387.19 | 3084204 | 1 | 509 |
| 328 | 347796.7 | 3108506 | 395 | 687 |
| 329 | 406498.4c | 3109384 | 112 | 525 |
| 330 | 3346307CB1 | 3120209 | 2 | 1747 |
| 332 | 4005778CB1 | 3121380 | 208 | 1220 |
| 334 | 995575.17 | 3123731 | 2033 | 2944 |
| 335 | 863406CB1 | 3128810 | 62 | 4366 |
| 337 | 413864.17 | 3129338 | 1 | 1603 |
| 338 | 350106.16 | 3136857 | 1045 | 1577 |
| 339 | 399785.1 | 3158828 | 199 | 627 |
| 340 | 010498.19 | 3170010 | 3434 | 4175 |
| 341 | 255824.39 | 3208425 | 258 | 755 |
| 342 | 2706606CB1 | 3208425 | 347 | 1869 |
| 344 | 118006.1 | 3222802 | 1 | 162 |
| 345 | 1039889.26 | 3225977 | 64 | 1971 |
| 346 | 481480.7 | 3240708 | 1 | 392 |
| 347 | 662575CB1 | 3272165 | 17 | 1864 |
| 349 | 027619.3 | 3284411 | 5 | 813 |
| 350 | 235447.5 | 3345528 | 8274 | 8706 |
| 351 | 331104.2 | 3380034 | 2256 | 3067 |
| 352 | 348390.2 | 3381870 | 50 | 205 |
| 353 | 127004.1 | 3407653 | 1 | 640 |
| 354 | 026190.1 | 3427373 | 970 | 1345 |
| 355 | 250330.1 | 3472927 | 1 | 554 |
| 356 | 480375.28 | 3493381 | 100 | 548 |
| 357 | 364726.10 | 3494714 | 1 | 498 |
| 358 | 364726.12 | 3494714 | 3939 | 4473 |
| 359 | 1505038CB1 | 3606046 | 7 | 3701 |
| 361 | 903508.12 | 3715059 | 1589 | 2966 |
| 362 | 346716.17c | 3792988 | 6200 | 6704 |
| 363 | 346716.21c | 3792988 | 55 | 705 |
| 364 | 330776.1 | 3815422 | 2049 | 2357 |
| 365 | 407999.1c | 4019706 | 1 | 368 |
| 366 | 1719478CB1 | 4066764 | 1 | 6348 |
| 368 | 351157.2 | 4070979 | 59 | 653 |
| 369 | 088957CB1 | 4087621 | 1888 | 4200 |
| 369 | 088957CB1 | 5398701 | 1888 | 4200 |
| 371 | 980446.1 | 4091186 | 1 | 801 |
| 372 | 198827.1 | 4092112 | 90 | 1147 |
| 373 | 1102297.22 | 4107126 | 1584 | 1682 |
| 374 | 215112.1 | 4110976 | 1 | 522 |

TABLE 6-continued

| SEQ ID NO: | TEMPLATE I | CLONE ID | START | STOP |
|---|---|---|---|---|
| 375 | 171495.1 | 4203937 | 51 | 1219 |
| 376 | 242010.43 | 4246966 | 150 | 335 |
| 377 | 5834958CB1 | 4254855 | 1 | 2919 |
| 379 | 335648.1c | 4284384 | 33 | 430 |
| 380 | 333840.1 | 4287327 | 1166 | 1659 |
| 381 | 480885.2 | 4403805 | 190 | 2066 |
| 382 | 998106.8c | 4508879 | 15 | 869 |
| 383 | 400701.4 | 4549259 | 1 | 449 |
| 384 | 1100320.4 | 4556538 | 14 | 796 |
| 385 | 246727.11 | 4715924 | 272 | 642 |
| 386 | 246727.17 | 4715924 | 1249 | 1618 |
| 387 | 1102322.12c | 4721130 | 207 | 672 |
| 388 | 1102322.18 | 4721130 | 844 | 1068 |

TABLE 6-continued

| SEQ ID NO: | TEMPLATE I | CLONE ID | START | STOP |
|---|---|---|---|---|
| 389 | 2070610CB1 | 4795635 | 249 | 1680 |
| 391 | 336733.3 | 5047895 | 1 | 420 |
| 392 | 1326902.13 | 5077219 | 105 | 580 |
| 393 | 1326902.6 | 5077219 | 983 | 1443 |
| 394 | 013521.16 | 5093071 | 312 | 767 |
| 395 | 985369.1 | 5102731 | 337 | 1131 |
| 396 | 002455.1 | 5266015 | 670 | 1134 |
| 397 | 372647.1 | 5266376 | 81 | 792 |
| 398 | 208075.1 | 5293028 | 417 | 737 |
| 399 | 209279.1 | 5399371 | 2090 | 2521 |
| 400 | 381058.1 | 5512044 | 1 | 517 |
| 401 | 046977.1 | 5541949 | 1 | 308 |

TABLE 7

| SEQ ID NO: | Template ID | Tissue Distribution |
|---|---|---|
| 1 | 220060.4 | Liver - 35%, Sense Organs - 28%, Nervous System - 14% |
| 3 | 1266683.1 | Embryonic Structures - 100% |
| 4 | 129384.1c | Skin - 64%, Respiratory System - 14%, Hemic and Immune System - 14% |
| 9 | 1102322.16 | Skin - 12%, Sense Organs - 11% |
| 12 | 978222.4 | Germ Cells - 42%, Unclassified/Mixed - 15%, Musculoskeletal System - 10%, Female Genitalia - 10% |
| 13 | 978222.5 | Connective Tissue - 18%, Male Genilalia - 18%, Musculoskeletal System - 15% |
| 22 | 238349.2 | Embryonic Structures - 17% |
| 23 | 238349.4c | Hemic and Immune System - 100% |
| 24 | 402917.3c | Digestive System - 42%, Urinary Tract - 40% |
| 25 | 406330.1 | Germ Cells - 64%, Nervous System - 36% |
| 37 | 237416.12c | Unclassified/Mixed - 93% |
| 38 | 237416.14 | Exocrine Glands - 17%, Liver - 16%, Female Genitalia - 14% |
| 43 | 246946.1 | Female Genitalia - 86%, Hemic and Immune System - 10% |
| 45 | 985556.1 | Hemic and Immune System - 29%, Respiratory System - 13% |
| 48 | 996427.2 | Hemic and Immune System - 19%, Exocrine Glands - 13%, Respiratory System - 12% |
| 51 | 236359.2 | Connective Tissue - 54%, Hemic and Immune System - 46% |
| 53 | 198268.1 | Hemic and Immune System - 82%, Male Genitalia - 18% |
| 54 | 978740.3 | Sense Organs - 14%, Germ Cells - 11% |
| 55 | 400197.1 | Skin - 37%, Pancreas - 13%, Embryonic Structures - 12% |
| 56 | 235687.5c | Germ Cells - 44%, Skin - 23%, Unclassified/Mixed - 16% |
| 59 | 978690.6 | Unclassified/Mixed - 33%, Nervous System - 21%, Respiratory System - 19% |
| 60 | 348072.5 | Liver - 90% |
| 70 | 407096.2 | Connective Tissue - 15% |
| 71 | 209265.54 | Germ Cells - 27%, Musculoskeletal System - 11% |
| 79 | 231588.6c | Respiratory System - 25%, Female Genitalia - 25%, Nervous System - 17%, Digestive System - 17%, Hemic and Immune System - 17% |
| 80 | 152298.2 | Respiratory System - 60%, Digestive System - 40% |
| 81 | 199507.1 | Nervous System - 50%, Digestive System - 50% |
| 84 | 289671.27 | Sense Organs - 26%, Urinary Tract - 19% |
| 87 | 263336.57 | Liver - 23%, Urinary Tract - 17%, Hemic and Immune System - 17% |
| 88 | 464689.40 | Female Genitalia - 13%, Liver - 11% |
| 89 | 155943.1 | Unclassified/Mixed - 33%, Germ Cells - 30% |
| 90 | 243794.19c | Stomatognathic System - 14% |
| 96 | 403717.1 | Unclassified/Mixed - 44%, Embryonic Structures - 21%, Urinary Tract - 19% |
| 98 | 347055.4 | Skin- 15%, Liver- 12% |
| 99 | 898899.11 | Liver - 41%, Respiratory System - 14%, Pancreas - 12% |
| 100 | 898899.32 | Liver - 62%, Urinary Tract - 12% |
| 106 | 282397.85c | Embryonic Structures - 11% |
| 107 | 282397.94 | Endocrine System - 71%, Hemic and Immune System - 29% |
| 110 | 1100769.2 | Pancreas - 10% |
| 111 | 332521.1 | Unclassified/Mixed - 19%, Embryonic Structures - 18%, Musculoskeletal System - 12% |
| 112 | 225080.16 | Skin - 18% |
| 113 | 334851.5 | Liver - 16%, Exocrine Glands - 12%, Digestive System - 11% |

TABLE 7-continued

| SEQ ID NO: | Template ID | Tissue Distribution |
|---|---|---|
| 114 | 995529.7 | Pancreas - 27%, Hemic and Immune System - 23%, Exocrine Glands - 14% |
| 115 | 995529.8 | Unclassified/Mixed - 24%, Hemic and Immune System - 15% |
| 116 | 201851.1 | Sense Organs - 21%, Unclassified/Mixed - 11%, Nervous System - 11% |
| 119 | 481231.14 | Liver - 84%, Digestive System - 12% |
| 124 | 153825.1 | Embryonic Structures - 43%, Connective Tissue - 16%, Unclassified/Mixed - 12% |
| 125 | 403484.2c | Germ Cells - 83% |
| 128 | 1096583.1 | Pancreas - 42%, Unclassified/Mixed - 42%, Cardiovascular System - 17% |
| 135 | 232567.4 | Skin - 29%, Germ Cells - 22% |
| 136 | 218419.1 | Unclassified/Mixed - 42%, Connective Tissue - 29%, Nervous System - 17% |
| 139 | 360961.19 | Connective Tissue - 13%, Endocrine System - 13%, Skin - 11% |
| 144 | 242010.16 | Nervous System - 18%, Musculoskeletal System - 16% |
| 147 | 988653.1 | Connective Tissue - 12%, Exocrine Glands - 12% |
| 150 | 236196.3 | Endocrine System - 15%, Musculoskeletal System - 14%, Liver - 10% |
| 151 | 442308.1 | Endocrine System - 78%, Nervous System - 22% |
| 155 | 1095192.1 | Nervous System - 100% |
| 156 | 233003.20 | Digestive System - 67%, Nervous System - 33% |
| 159 | 978276.8 | Sense Organs - 12%, Unclassified/Mixed - 11% |
| 160 | 405844.21 | Embryonic Structures - 18%, Liver - 16%, Exocrine Glands - 11% |
| 161 | 405844.22 | Embryonic Structures - 11% |
| 167 | 220134.1 | Skin - 22%, Liver- 14% |
| 169 | 206044.1 | Skin - 81%, Unclassified/Mixed - 19% |
| 170 | 382906.16 | Skin - 35%, Pancreas - 25%, Hemic and Immune System - 13% |
| 171 | 331306.1 | Hemic and Immune System - 25%, Unclassified/Mixed - 13%, Respiratory System - 13% |
| 172 | 1094829.20 | Musculoskeletal System - 10% |
| 173 | 1094829.38 | Stomatognathic System - 11% |
| 174 | 1135580.4 | Nervous System - 22%, Unclassified/Mixed - 15%, Connective Tissue - 11% |
| 181 | 206397.1 | Connective Tissue - 100% |
| 182 | 461707.40 | Liver - 27%, Sense Organs - 26% |
| 185 | 474372.7 | Hemic and Immune System - 15% |
| 190 | 245259.16 | Urinary Tract - 12%, Germ Cells - 11% |
| 193 | 1040667.43 | Hemic and Immune System - 100% |
| 198 | 1326983.14 | Liver - 10% |
| 205 | 1000133.1 | Stomatognathic System - 13%, Cardiovascular System - 12% |
| 210 | 239996.1 | Skin - 45%, Connective Tissue - 23%, Hemic and Immune System - 19% |
| 211 | 1097380.1 | Sense Organs - 14%, Embryonic Structures - 11% |
| 214 | 253987.16 | Urinary Tract - 27%, Cardiovascular System - 18%, Musculoskeletal System - 14% |
| 215 | 344553.1 | Digestive System - 38%, Liver - 19%, Pancreas - 18% |
| 216 | 410785.1 | Liver - 53%, Hemic and Immune System - 14%, Urinary Tract - 12% |
| 217 | 237623.6 | Digestive System - 38%, Pancreas - 19%, Respiratory System - 11% |
| 219 | 1099500.15 | Stomatognathic System - 11% |
| 220 | 1099500.18 | Nervous System - 11% |
| 223 | 380283.1 | Embryonic Structures - 31%, Endocrine System - 13% |
| 226 | 333776.1c | Hemic and Immune System - 71%, Male Genitalia - 29% |
| 229 | 147541.17 | Sense Organs - 12% |
| 230 | 331120.16c | Liver - 13%, Germ Cells - 12%, Unclassified/Mixed - 11% |
| 233 | 413268.6 | Stomatognathic System - 11% |
| 236 | 337448.1c | Unclassified/Mixed - 49%, Germ Cells - 23%, Male Genitalia - 14% |
| 237 | 228304.19 | Liver - 42%, Unclassified/Mixed - 10% |
| 238 | 420527.25 | Sense Organs - 12% |
| 239 | 998034.3 | Germ Cells - 23% |
| 243 | 346209.3 | Digestive System - 24%, Pancreas - 12% |
| 248 | 481231.16 | Liver - 83%, Digestive System - 12% |
| 249 | 481231.17 | Liver - 70%, Digestive System - 14% |
| 250 | 1045853.2 | Liver - 93% |
| 251 | 336615.1 | Sense Organs - 57%, Endocrine System - 15%, Unclassified/Mixed - 11% |
| 252 | 1328423.2 | Endocrine System - 17%, Embryonic Structures - 11% |
| 254 | 1081605.3 | Unclassified/Mixed - 26%, Endocrine System - 16%, Male Genitalia - 13% |
| 255 | 1053517.1 | Urinary Tract- 100% |
| 261 | 240518.21 | Liver - 26%, Respiratory System - 19%, Connective Tissue - 17% |
| 262 | 240518.34 | Pancreas - 10% |
| 264 | 350502.3 | Connective Tissue - 44%, Cardiovascular System - 25%, Urinary Tract - 25% |
| 265 | 350502.4c | Exocrine Glands - 28%, Urinary Tract - 28%, Cardiovascular System - 14% |
| 266 | 253783.3 | Male Genitalia - 30%, Urinary Tract - 27%, Nervous System - 24% |
| 268 | 902559.1 | Digestive System - 12%, Exocrine Glands - 11%, Urinary Tract - 10% |
| 273 | 198317.1 | Musculoskeletal System - 16%, Exocrine Glands - 15%, Embryonic Structures - 12%, Unclassified/Mixed - 12% |
| 276 | 474691.3 | Germ Cells - 14% |
| 279 | 201395.4c | Nervous System - 38%, Endocrine System - 14% |
| 280 | 233189.21 | Liver - 30% |

TABLE 7-continued

| SEQ ID NO: | Template ID | Tissue Distribution |
|---|---|---|
| 281 | 196606.6c | Hemic and Immune System - 100% |
| 282 | 196606.8c | Sense Organs - 11%, Connective Tissue - 11% |
| 283 | 1040190.3 | Hemic and Immune System - 37%, Germ Cells - 13% |
| 286 | 480453.16c | Urinary Tract - 10% |
| 287 | 1095604.1 | Skin - 28%, Embryonic Structures - 19%, Endocrine System - 14% |
| 289 | 230611.1 | Respiratory System - 60%, Hemic and Immune System - 40% |
| 292 | 1000133.12 | Cardiovascular System - 15% |
| 293 | 400253.17c | Germ Cells - 31% |
| 294 | 400253.5 | Liver - 41%, Urinary Tract - 19%, Exocrine Glands - 19% |
| 301 | 984236.1c | Digestive System - 35%, Liver - 30%, Female Genitalia - 14% |
| 302 | 984236.2c | Digestive System - 72%, Exocrine Glands - 22% |
| 303 | 348082.5 | Connective Tissue - 36%, Germ Cells - 19% |
| 304 | 348082.7 | Embryonic Structures - 38%, Skin - 23%, Digestive System - 10% |
| 305 | 1097910.1 | Liver - 48%, Male Genitalia - 20%, Endocrine System - 11% |
| 306 | 246841.1 | Sense Organs - 30% |
| 307 | 351241.1 | Urinary Tract - 36%, Hemic and Immune System - 36%, Musculoskeletal System - 27% |
| 315 | 232818.15 | Skin - 12% |
| 316 | 347781.10 | Skin - 20% |
| 319 | 360532.1 | Stomatognathic System - 67%, Musculoskeletal System - 16%, Cardiovascular System - 12% |
| 320 | 360532.9 | Musculoskeletal System - 49%, Cardiovascular System - 22%, Sense Organs - 11% |
| 321 | 110245.1 | Cardiovascular System - 67%, Hemic and Immune System - 33% |
| 325 | 474588.21 | Female Genitalia - 17%, Respiratory System - 15%, Embryonic Structures - 13% |
| 326 | 407838.1 | Musculoskeletal System - 60%, Respiratory System - 30%, Nervous System - 10% |
| 327 | 994387.19 | Female Genitalia - 75%, Nervous System - 25% |
| 328 | 347796.7 | Stomatognathic System - 13% |
| 329 | 406498.4c | Sense Organs - 75%, Unclassified/Mixed - 14% |
| 334 | 995575.17 | Sense Organs - 14% |
| 337 | 413864.17 | Liver - 18%, Respiratory System - 12%, Exocrine Glands - 11% |
| 339 | 399785.1 | Pancreas - 31%, Unclassified/Mixed - 31%, Male Genitalia - 16% |
| 341 | 255824.39 | Stomatognathic System - 15%, Musculoskeletal System - 13% |
| 344 | 118006.1 | Digestive System - 100% |
| 346 | 481480.7 | Digestive System - 100% |
| 350 | 235447.5 | Embryonic Structures - 11%, Liver - 11% |
| 351 | 331104.2 | Liver - 64%, Hemic and Immune System - 10% |
| 352 | 348390.2 | Digestive System - 46%, Female Genitalia - 21%, Male Genitalia - 20% |
| 353 | 127004.1 | Germ Cells - 84% |
| 355 | 250330.1 | Hemic and Immune System - 63%, Respiratory System - 38%; |
| 356 | 480375.28 | Musculoskeletal System - 46%, Endocrine System - 38%, Male Genitalia - 15% |
| 357 | 364726.10 | Sense Organs - 39% |
| 358 | 364726.12 | Sense Organs - 15%, Unclassified/Mixed - 14% |
| 361 | 903508.12 | Embryonic Structures - 35%, Germ Cells - 15%, Liver - 14% |
| 362 | 346716.17c | Unclassified/Mixed - 23%, Germ Cells - 11%, Hemic and Immune System - 10% |
| 363 | 346716.21c | Cardiovascular System - 18%, Nervous System - 18%, Endocrine System - 13%, Male Genitalia - 13% |
| 364 | 330776.1 | Sense Organs - 17%, Connective Tissue - 15% |
| 365 | 407999.1c | Nervous System - 100% |
| 368 | 351157.2 | Urinary Tract - 80%, Hemic and Immune System - 20% |
| 371 | 980446.1 | Embryonic Structures - 31%, Nervous System - 16%, Connective Tissue - 11%, Male Genitalia - 11% |
| 372 | 198827.1 | Connective Tissue - 25%, Nervous System - 17%, Exocrine Glands - 11% |
| 374 | 215112.1 | Male Genitalia - 83%, Nervous System - 17% |
| 375 | 171495.1 | Unclassified/Mixed - 43%, Cardiovascular System - 18%, Respiratory System - 14% |
| 376 | 242010.43 | Musculoskeletal System - 21%, Nervous System - 20% |
| 379 | 335648.1c | Liver - 72%, Exocrine Glands - 18% |
| 380 | 333840.1 | Liver - 71%, Urinary Tract - 20% |
| 381 | 480885.2 | Connective Tissue - 14%, Male Genitalia - 14% |
| 382 | 998106.8c | Unclassified/Mixed - 36%, Respiratory System - 26% |
| 383 | 400701.4 | Nervous System - 43%, Endocrine System - 36%, Female Genitalia - 21% |
| 384 | 1100320.4 | Nervous System - 10%, Skin - 10%, Respiratory System - 10%, Endocrine System - 10% |
| 385 | 246727.11 | Embryonic Structures - 26%, Connective Tissue - 21%, Male Genitalia - 15% |
| 386 | 246727.17 | Sense Organs - 13% |
| 387 | 1102322.12c | Musculoskeletal System - 41%, Hemic and Immune System - 34% |
| 388 | 1102322.18 | Sense Organs - 25%, Connective Tissue - 10% |
| 391 | 336733.3 | Cardiovascular System - 25%, Embryonic Structures - 25%, Skin - 13% |
| 392 | 1326902.13 | Musculoskeletal System - 25%, Pancreas - 19%, Digestive System - 13% |

TABLE 7-continued

| SEQ ID NO: | Template ID | Tissue Distribution |
|---|---|---|
| 393 | 1326902.6 | Connective Tissue - 12% |
| 395 | 985369.1 | Germ Cells - 16%, Male Genitalia - 12% |
| 397 | 372647.1 | Nervous System - 100% |
| 398 | 208075.1 | Hemic and Immune System - 28%, Unclassified/Mixed - 20%, Exocrine Glands - 13% |
| 399 | 209279.1 | Liver - 76% |
| 400 | 381058.1 | Male Genitalia - 67%, Nervous System - 33% |

SEQUENCE LISTING (401 sequences)

SEQ ID NO: 1 - DNA, 572 bp, Homo sapiens
  misc_feature: Incyte ID No: 220060.4
atggcttctcatcgtctgctcctcctctgccttgctggactggtatttgtgtctgaggctggccctacgggcaccggtgaatccaagtgtcctctgatggtcaaagttctagatgctgtccgaggcagtcctgccatcaatgtggccgtgcatgtgttcagaaaggctgctgatgacacctgggagccatttgcctctgggaaaaccagtgagtctggagagctgcatgggctcacaactgaggaggaatttgtagaagggatatacaaagtggaaatagacaccaaatcttactggaaggcacttggcatctccccattccatgagcatgcagaggtggtattcacagccaacgactccggcccccgccgctacaccattgccgccctgctgagcccctactcctattccaccacggctgtcgtcaccaatcccaaggaatgaggagtggacctgaaggacgagggatgggatttcatgtaaccaagagtattccatttttagtaaagcactgttttcacctcatatgctatgttagaagtccaggcagagacaataaaacattcctgtga

SEQ ID NO: 2 - DNA, 263 bp, Homo sapiens
  misc_feature: Incyte ID No: 016238.1
  unsure 22, 26, 42: a, t, c, g, or other
gacatgatcagtgaattatggntgantatgattatctttctntttgtcctgttgaatactcattatgtgtaagagactgtgctaggcaatgtgaatgatactaacatcaacaagatccaatctttcagggacgtgatgcctttaaggatctggcaagctagtgatatgtgtcagaaatcaaactaagaattatctgatgaatgttaactctcctattgcattagactatgaaaattatattccaaatctcaacagtttaattt

SEQ ID NO: 3 - DNA, 212 bp, Homo sapiens
  misc_feature: Incyte ID No: 1266683.1
  unsure 42, 161: a, t, c, g, or other
gtcgcgggccgactggtgtttatccgtcactcgccgaggttncttgggtcatggtgccagcctgactgagaagaggacgctcccgggagacgaatgaggaaccacctcctcctactgttcaagtacaggggcctggtccgcaaagggaagaaaagcaaaanacgaaaatggctaaattcgtgatccgcccagccactgccgccgactgcagt

SEQ ID NO: 4 - DNA, 612 bp, Homo sapiens
  misc_feature: Incyte ID No: 129384.1c
  unsure 482, 555: a, t, c, g, or other
tagggtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcatgcgttacctgtcgctttggggaggccgctgccgggatccggccccgaacagcccgggggggcaggggcgggggtcgtcgaggggatgggggnagagagcaggcggcgggcaggatgcccggggtgagttggcgagttccggatcttcgctcctctctcccggggntcgggcgacgcagcctaccgggctgtcttcgccgctcaccggagagggtcgtccggg

SEQ ID NO: 5 - DNA, 2536 bp, Homo sapiens
  misc_feature: Incyte ID No: 3201389CB1
cggctgatcttttggtttgagggagagactggcgctggagttttgaattccgaatcatgtgcagaatgctgaatcttcccccagccaggacgaataagacagcgcggaaaagcagattctcgtaattctggaattgcatgttgcaaggagtctcctggatcttcgcacccagcttcgggtagggagggagtccgggtcccgggctaggccagcccggcaggtggagagggtccccggcagccccgcgcgcccctggccatgtctttaatgccctgccccttcatgtggccttctgagggttcccagggctggccagggttgtttcccacccgcgcgcgcgctctcacccccagccaaacccacctggcagggctccctccagccgagaccttttgattcccggctcccgcgctcccgcctccgcgccagcccgggaggtggccctggacagccggacctcgcccggccccggctgggaccatggtgtttctctcgggaaatgcttccgacagctccaactgcacccaaccgccggcaccggtgaacatttccaaggccattctgctcggggtgatcttggggggcctcattcttttcggggtgctgggtaacatcctagtgatcctctccgtagcctgtcaccgacacctgcactcagtcacgcactactacatcgtcaacctggcggtggccgacctcctgctcacctccacggtgctgcccttctccgccatcttcgaggtcctaggctactgggccttcggcagggtcttctgcaacatctgggcggcagtggatgtgctgtgctgcaccgcgtccatcatgggcctctgcatcatctccatcgaccgctacatcggcgtgagctacccgctgcgctacccaaccatcgtcacccagaggaggggtctcatggctctgctctgcgtctgggcactctccctggtcatatccattggacccctgttcggctggaggcagccggcccccgaggacgagaccatctgccagatcaacgaggagccgggctacgtgctcttctcagcgctgggctccttctacctgcctctggccatcatcctggtcatgtactgccgcgtctacgtggtggccaagagggagagccggggcctcaagtctggcctcaagaccgacaagtcggactcggagcaagtgacgctccgcatccatcggaaaaacgccccggcaggaggcagcgggatggccagcgccaagaccaagacgcacttctcagtgaggctcctcaagttctcccgggagaagaaagcggccaaaacgctgggcatcgtggtcggctgcttcgtcctctgctggctgccttttttcttagtcatgcccattgggtctttcttccctgatttcaagccctctgaaacagtttttaaaatagtattttggctcggatatctaaacagctgcatcaaccccatcatatacccatgctccagccaagagttcaaaaaggcctttcagaatgtcttgagaatccagtgtctccgcagaaagcagtcttccaaacatgccctgggctacaccctgcacccgcccagccaggccgtggaagggcaacacaaggacatggtgcgcatccccgtgggatcaagagagaccttctacaggatctccaagacggatggcgtttgtgaatggaaatttttctcttccatgccccgtggatctgccaggattacagtgtccaaagaccaatcctcctgtaccacagcccggggacacacacccatgacatgaagccagcttcccgtccacgactgttgtccttactgcccaaggaaggggagcatgaaacccaccactggtcctgcgacccactgtctttggaatccaccccaggagcccaggagccttgcctgacacttggatttacttctttatcaagcatccatctgactaaggcacaaatccaacatgttactgttactgatacaggaaaaacagtaacttaaggaatgatcatgaatgcaaagggaaagaggaaaagagccttcagggacaaatagctcgattttttgtaaatcagtttcatacaacctccctcccccatttcattcttaaaagttaattgagaatcatcagccacgtgtagggtgtgaggaattccataaggcaccccagtttcttcaataagtaaatggcatttttaaaaggggaacttttatgggttaaaatattcttaagagatgtattcatcaagtatactgtacaagccttgttcatttagattgaaacaaagtgtaaaaagacatttttgaagtaattggagaaaattaagcataggctgtgtcctattagatgttagataattagatcgttattttaaattttgttggatgtgataatggcattgtccttaactggtaagtgcatatcgaagtatgtttgcaatttgctttaaagttttattgccaaaagtggggaagcaagtgtgatagatgaaataagaatggcaggcaaggtcacatgccgtacttccatgtctgtgcaatgttgaaattta

SEQ ID NO: 6 - protein, 429 aa, Homo sapiens
  misc_feature: Incyte ID No: 3201389CD1
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLRRKQSSKHALGYTLHPPSQAVEGQHKDMVRIPVGSRETFYRISKTDGVCEWKFFSSMPRGSARITVSKDQSSCTTARGHTPMT

SEQ ID NO: 7 - DNA, 624 bp, Homo sapiens
  misc_feature: Incyte ID No: 086390CB1
tatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaattgaaaaaaaaaaa

SEQ ID NO: 8 - protein, 130 aa, Homo sapiens
  misc_feature: Incyte ID No: 086390CD1
MRLFTGIVFCSLVMGVTSESWRSFFKEALQGVGDMGRAYWDIMISNHQNSNRYLYARGNYDAAQRGPGGVWAAKLISRSRVYLQGLIDYYLFGNSSTVLEDSKSNEKAEEWGRSGKDPDRFRPDGLPKKY

SEQ ID NO: 9 - DNA, 852 bp, Homo sapiens
  misc_feature: Incyte ID No: 1102322.16
cataagaaggacatcagtgagaacaagagagctgaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgc

SEQ ID NO: 10 - DNA, 2260 bp, Homo sapiens
  misc_feature: Incyte ID No: 1545176CB1
aaaccggtctcattgaactcgcctgcagctcttgggtttttttgtggcttccttcgttattggagccaggcctacaccccagcaaccatgtccaagggacctgcagttggtattgatcttggcaccacctactcttgtgtgggtgttttccagcacggaaaagtcgagataattgccaatgatcagggaaaccgaaccactccaagctatgtcgcctttacggacactgaacggttgatcggtgatgccgcaaagaatcaagttgcaatgaaccccaccaacacagtttttgatgccaaacgtctgattggacgcagatttgatgatgctgttgtccagtctgatatgaaacattggccctttatggtggtgaatgatgctggcaggcccaaggtccaagtagaatacaagggagagaccaaaagcttctatccagaggaggtgtcttctatggttctgacaaagatgaaggaaattgcagaagcctaccttgggaagactgttaccaatgctgtggtcacagtgccagcttactttaatgactctcagcgtcaggctaccaaagatgctggaactattgctggtctcaatgtacttagaattattaatgagccaactgctgctgctattgcttacggcttagacaaaaaggttggagcagaaagaaacgtgctcatctttgacctgggaggtggcacttttgatgtgtcaatcctcactattgaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaat

SEQ ID NO: 11 - protein, 646 aa, Homo sapiens
  misc_feature: Incyte ID No: 1545176CD1
MSKGPAVGIDLGTTYSCVGVFQHGKVEIIANDQGNRTTPSYVAFTDTERLIGDAAKNQVAMNPTNTVFDAKRLIGRRFDDAVVQSDMKHWPFMVVNDAGRPKVQVEYKGETKSFYPEEVSSMVLTKMKEIAEAYLGKTVTNAVVTVPAYFNDSQRQATKDAGTIAGLNVLRIINEPTAAAIAYGLDKKVGAERNVLIFDLGGGTFDVSILTIEDGIFEVKSTAGDTHLGGEDFDNRMVNHFIAEFKRKHKKDISENKRAVRRLRTACERAKRTLSSSTQASIEIDSLYEGIDFYTSITRARFEELNADLFRGTLDPVEKALRDAKLDKSQIHDIVLVGGSTRIPKIQKLLQDFFNGKELNKSINPDEAVAYGAAVQAAILSGDKSENVQDLLLLDVTPLSLGIETAGGVMTVLIKRNTTIPTKQTQTFTTYSDNQPGVLIQVYEGERAMTKDNNLLGKFELTGIPPAPRGVPQIEVTFDIDANGILNVSAVDKSTGKENKITITNDKGRLSKEDIERMVQEAEKYKAEDEKQRDKVSSKNSLESYAFNMKATVEDEKLQGKINDEDKQKILDKCNEIINWLDKNQTAEKEEFEHQQKELEKVCNPIITKLYQSAGGMPGGMPGGFPGGGAPPSGGASSGPTIEEVD

SEQ ID NO: 12 - DNA, 1335 bp, Homo sapiens
  misc_feature: Incyte ID No: 978222.4
aagagagggattatagagaaaaggcgtcgggatcggataaataacagtttatctgagttgagaagacttgtgccaactgcttttgaaaaacaaggatctgcaaagttagaaaaagctgaaatattgcaaatgacagtggatcatttgaagatgcttcaggcaacagggggtaaaggctactttgacgcacacgctcttgccatggacttcatgagcataggattccgagagtgcctaacagaagttgcgcggtacctgagctccgtggaaggcctggactcctcggatccgctgcgggtgcggcttgtgtctcatctcagcacttgcgccacccagcgggacgcggcggccatgacatcctccatggcccaccaccatcatccgctccacccgcatcactgggccgccgccttccaccacctgcccgcaagccctgctccagcccaacggcctccatgcctcagagtcaaccccttgtcgcctctccacaacttcagaagtgcctcctgcccacggctctgctctcctcacggccacgtttgcccatgcggattcagccctccgaatgccatccacgggcagcgtcgccccctgcgtgccacctctctccacctctctcttgtccctctctgccaccgtccacgccgcagccgcagcagccaccgcggctgcacacagcttccctctgtccttcgcgggggcattccccatgcttcccccaaacgcagcagcagcagtgccgcggccacagccatcagcccgcccttgtcagtatcagccacgtccagtcctcagcagaccagcagtggaacaaacaataaaccttaccgaccctgggggacagaagttggagctttttaaatttttcttgaacttcttgcaatagtaactgaatgtcctccatttcagagtcagcttaaaacctctgcaccctgaaggtagccatacagatgccgacagatccacaaaggaacaataaagctatttgagacacaaacctcacgagtggaaatgtggtattctcttttttttctcccccttttttgtttggttcaaggcagctcggtaactgacatcagcaacttttgaaaacttcacacttgttaccatttagaagtttcctggaaaatatatggaccgtaccatccagcagtgcatcagtatgtctgaattggggaagtaaaatgccctgactgaattctcttgagactagatgggacatacatatatagagagagagtgagagagtcgtgtttcgtaagtgcctgagcttaggaagttttcttctggatatataacattgcacaagggaagacgagtgtggaggataggtta

SEQ ID NO: 13 - DNA, 802 bp, Homo sapiens
  misc_feature: Incyte ID No: 978222.5
atgccaagaggtgacatttagcagtgcattggtataagcaattatttcatcagttctcagattaacaagcatttctgctctgcctgcaggcccccaggcacttttttttttggatggctcaaaatatggtgcttctttatataaaccttacatttatatagtgcacctatgagcagttgcctaccatgtgtccaccagaggctatttaattcatgccaacttgaaaactctccagtttgtaggagtttggtttaatttattcagtttcattaggactatttttatatatttatcctcttcattttctcctaatgatgcaacatctattcttgtcaccctttgggagaagttacatttctggaggtgatgaagcaaggagggagcactaggaagagaaaagctacaatttttaaagctctttgtcaagttagtgattgcatttgatcccaaaacaagatgaatgtatgcaatgggatgtacataagttatttttgcccatgcctaaactagtgctatgtaatggggttgtggttttgtttttttcgatttcgtttaatgacaaaataatctcttaatatgctgaaatcaagcacgtgagagtttttgtttaaaagataagagacacagcatgtattatgcacttcatttctctactgtgtggagaaagcaataaacattatgagaatgttaaacgttatgcaaaattatacttttaaatatttgttttgaaattactgtacctagtcttttttgcattactttgtaacctttttctatgcaagagtctttacataccactaat

SEQ ID NO: 14 - DNA, 7626 bp, Homo sapiens
  misc_feature: Incyte ID No: 1720920CB1
atgcagtccggccgcggccccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggccattatgaagctttctccaccctggctcccgaggcttggccagccatggagctgcctgagccatgcgtgcctgagccagggctgcctcctgtctttgccaatttcacccagctgctgactatcagcccactggtggtggccgagggtggcacagcctggcttgagtggaggcatgtgcagcccacgctggacctgatggaggctgagctgcgcaaatcccaggtgctgttcagcgtgacccgaggggcacactatggcgagctcgagctggacatcctgggtgcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccactgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcatagtacaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagctcgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgacggtggtgagggtgtcctctctgctgaccacctctttgtcaagagtctcaacagtgccagctacctctatgaggtcatggagcggccccgccatgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacaactagtccgggctggtcagccagccacagccttctcccagcaggacctgctggatggggccgttctctatagccacaatggcagcctcagccccgaagacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggacccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggccggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcccggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccagtccaacccaggccagcctttgtctctgccccagagttgagaaaaaaacttcctcccctgggttttttagggagatggtatcccctggagtagagggcaagaggagagagcgctccagtctagaaggcataagccaataggatgatatattcagggtgcaagggtggtaggttgctctggggatgggcttatttaaggaggatgcaaggaagctatttaat

SEQ ID NO: 15 - protein, 2322 aa, Homo sapiens
  misc_feature: Incyte ID No: 1720920CD1
MQSGRGPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGAHYGELELDILGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHCGGPAQDLTFRVSDGLQASPPATLKVVAIRPAIQIHRSTGLRLAQGSAMPILPANLSVETNAVGQDVSVLFRVTGALQFGELQKHSTGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPDGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPEDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGPLQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 16 - DNA, 4510 bp, Homo sapiens
  misc_feature: Incyte ID No: 1857017CB1
ggctgagcgtcggcgccggggttcggtggcctctagtgagatctggaggatccaaggattctgtagctacaatgttgtcaagactttttcgaatgcatggcctctttgtggcctcccatccctgggaagtcatagtggggacagtgacactgaccatctgcatgatgtccatgaacatgtttactggtaacaataagatctgtggttggaattatgaatgtccaaagtttgaagaggatgttttgagcagtgacattataattctgacaataacacgatgcatagccatcctgtatatttacttccagttccagaatttacgtcaacttggatcaaaatatattttgggtattgctggccttttcacaattttctcaagttttgtattcagtacagttgtcattcacttcttagacaaagaattgacaggcttgaatgaagctttgccctttttcctacttttgattgacctttccagagcaagcacattagcaaagtttgccctcagttccaactcacaggatgaagtaagggaaaatattgctcgtggaatggcaattttaggtcctacgtttaccctcgatgctcttgttgaatgtcttgtgattggagttggtaccatgtcaggggtacgtcagcttgaaattatgtgctgctttggctgcatgtcagttcttgccaactacttcgtgttcatgactttcttcccagcttgtgtgtccttggtattagagctttctcgggaaagccgcgagggtcgtccaatttggcagctcagccattttgcccgagttttagaagaagaagaaaataagccgaatcctgtaactcagagggtcaagatgattatgtctctaggcttggttcttgttcatgctcacagtcgctggatagctgatccttctcctcaaaacagtacagcagatacttctaaggtttcattaggactggatgaaaatgtgtccaagagaattgaaccaagtgtttccctctggcagttttatctctctaaaatgatcagcatggatattgaacaagttattaccctaagtttagctctccttctggctgtcaagtacatcttctttgaacaaacagagacagaatctacactctcattaaaaaaccctatcacatctcctgtagtgacacaaaagaaagtcccagacaattgttgtagacgtgaacctatgctggtcagaaataaccagaaatgtgattcagtagaggaagagacagggataaaccgagaaagaaaagttgaggttataaaacccttagtggctgaaacagataccccaaacagagctacatttgtggttggtaactcctccttactcgatacttcatcagtactggtgacacaggaacctgaaattgaacttcccagggaacctcggcctaatgaagaatgtctacagatacttgggaatgcagagaaaggtgcaaaattccttagtgatgctgagatcatccagttagtcaatgctaagcatatcccagcctacaagttggaaactctgatggaaactcatgagcgtggtgtatctattcgccgacagttactttccaagaagctttcagaaccttcttctctccagtacctaccttacagggattataattactccttggtgatgggagcttgttgtgagaatgttattggatatatgcccatccctgttggagtggcaggacccctttgcttagatgaaaaagaatttcaggttccaatggcaacaacagaaggttgtcttgtggccagcaccaatagaggctgcagagcaataggtcttggtggaggtgccagcagccgagtccttgcagatgggatgactcgtggcccagttgtgcgtcttccacgtgcttgtgactctgcagaagtgaaagcctggctcgaaacatctgaagggttcgcagtgataaaggaggcatttgacagcactagcagatttgcacgtctacagaaacttcatacaagtatagctggacgcaacctttatatccgtttccagtccaggtcaggggatgccatggggatgaacatgatttcaaagggtacagagaaagcactttcaaaacttcacgagtatttccctgaaatgcagattctagccgttagtggtaactattgtactgacaagaaacctgctgctataaattggatagagggaagaggaaaatctgttgtttgtgaagctgtcattccagccaaggttgtcagagaagtattaaagactaccacagaggctatgattgaggtcaacattaacaagaatttagtgggctctgccatggctgggagcataggaggctacaacgcccatgcagcaaacattgtcaccgccatctacattgcctgtggacaggatgcagcacagaatgttggtagttcaaactgtattactttaatggaagcaagtggtcccacaaatgaagatttatatatcagctgcaccatgccatctatagagataggaacggtgggtggtgggaccaacctactacctcagcaagcctgtttgcagatgctaggtgttcaaggagcatgcaaagataatcctggggaaaatgcccggcagcttgcccgaattgtgtgtgggaccgtaatggctggggaattgtcacttatggcagcattggcagcaggacatcttgtcaaaagtcacatgattcacaacaggtcgaagatcaatttacaagacctccaaggagcttgcaccaagaagacagcctgaatagcccgacagttctgaactggaacatgggcattgggttctaaaggactaacataaaatctgtgaattaaaaaagctcaatgcattgtcttgtggaggatgaatagatgtgatcactgagacagccacttggtttttggctctttcagagaggtctcaggttctttccatgcagactcctcagatctgaacacagtttagtgctttacatgctgtgctctttgaagagatttcaacaagaatattgtatgttaaagcatcagagatggtaatctacagctcacctctgaaggcaaatataagctgggaaaaaagttttgatgaaattcttgaagttcatggtgatcagtgcaattgaccttctccctcacccctgccagttgaaaatggatttttaaattatactgtagctgatgaaactcctgattttgtagttaatttattaagtctgggatgtagaacttcaagaagtaagagctaagttctaagttcatgtttgtaaattaatacttcatttggtgctggtctattttgattttggggggtaatcagtattattcttcagaaggggacctgttttcttcaagggaagaaacactcttattcccaaactacagaataatgtgttaaacatgctaaatagttctatcaggaaaacaaatcactgtatttatctccgcaggctatttgttcagagaggccttttgtttaaatataaatgtttaaatataaatgtttgtctggattggctataacatgtctttcagcattaggcttttaagaaacacagggttttgtattctttactaaagatatcagagctcttaatgttgcttagatgagggtgactgtcaagtacaagcaagactgggaccttagaaatcattgtagaaacacagttttgaaagaaaaataccatgtctctaagccaactttaattgcttaaaagacatttttatttagttgaaaaatctagttttttttgtaaactgtatcaaatctgtatatgttgtaataaaacttatgctagtttattggaagtgttcaagaaataaaaatcaacttgtgtactgataaaatactctagcctgggccagagaagataatgttctttaatgttgtccaggaaaccctggcttgcttgccgagcctaatgaaagggaaagtcagctttcagagccagtgaaggagccacgtgaatggccctagaactgtgcctagttcctgtggccaggaggttggtgactgaaacattcacacagggctctttgatggacccacgaacgctcttagctttctcagggggtcagcagagttattgaatcttaattttttttaatgtacaagttttgtataaataataaagaactccttattttgtattacatctaatgcttcaagtgttgctcttggaaagctgatgatgtctcttgtagaagatggactctgaaaaacattccaggaaaccatggcagcatggagagcctcttagtgattgtgtctgcattgttattgtggaagatttaccttttctgttgtacgtaaagcttaaattgcttttgttgtgactttttagccagtgactttttctgagcttttcatggaagtggcagtgaaaaatatgttgagtgttcattttagtgactgtaattaatatcttgctggattaatgttttgtacaattactaaattgtatacattttgttatagaatacttttttctagtttcagtaaataatgaaaaggaagttaataccaaaaaaaaaaaaaaa

SEQ ID NO: 17 - protein, 888 aa, Homo sapiens [sequence omitted]

SEQ ID NO: 18 - DNA, 1580 bp, Homo sapiens
  misc_feature: Incyte ID No: 2114865CB1
cagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctgcagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggacaaaaaaaaaaaaaa

SEQ ID NO: 19 - protein, 423 aa, Homo sapiens
  misc_feature: Incyte ID No: 2114865CD1
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPADTQNIFFMSKVTNPKQA

SEQ ID NO: 20 - DNA, 10432 bp, Homo sapiens
  misc_feature: Incyte ID No: 2700132CB1
tggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagagtggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggctggaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacctagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaatgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtctcaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcagtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacagatctgtctttccaatggccggggggatttggtccccaaattaaggctattggacatctgcacaggacagtcta

SEQ ID NO: 21 - protein, 3256 aa, Homo sapiens
  misc_feature: Incyte ID No: 2700132CD1
MWPTRRLVTIKRSGVDGPHFPLSLSTCLFGRGIECDIRIQLPVVSKQHCKIEIHEQEAILHNFSSTNPTQVNGSVIDEPVRLKHGDVITIIDRSFRYENESLQSGRKSTEFPRKIREQEPARRVSRSSFSSDPDEKAQDSKAYSKITEGKVSGNPQVHIKNVKEDSTADDSKDSVAQGTTNVHSSEHAGRNGRNAADPISGDFKEISSVKLVSRYGELKSVPTTQCLDNSKKNESPFWKLYESVKKELDVKSQKENVLQYCRKSGLQTDYATEKESADGLQGETQLLVSRKSRPKSGGSGHAVAEPASPEQELDQNKGKGRDVESVQTPSKAVGASFPLYEPAKMKTPVQYSQQQNSPQKHKNKDLYTTGRRESVNLGKSEGFKAGDKTLTPRKLSTRNRTPAKVEDAADSATKPENLSSKTRGSIPTDVEVLPTETEIHNEPFLTLWLTQVERKIQKDSLSKPEKLGTTAGQMCSGLPGLSSVDINNFGDSINESEGIPLKRRRVSFGGHLRPELFDENLPPNTPLKRGEAPTKRKSLVMHTPPVLKKIIKEQPQPSGKQESGSEIHVEVKAQSLVISPPAPSPRKTPVASDQRRRSCKTAPASSSKSQTEVPKRGGERVATCLQKRVSISRSQHDILQMICSKRRSGASEANLIVAKSWADVVKLGAKQTQTKVIKHGPQRSMNKRQRRPATPKKPVGEVHSQFSTGHANSPCTIIIGKAHTEKVHVPARPYRVLNNFISNQKMDFKEDLSGIAEMFKTPVKEQPQLTSTCHIAISNSENLLGKQFQGTDSGEEPLLPTSESFGGNVFFSAQNAAKQPSDKCSASPPLRRQCIRENGNVAKTPRNTYKMTSLETKTSDTETEPSKTVSTVNRSGRSTEFRNIQKLPVESKSEETNTEIVECILKRGQKATLLQQRREGEMKEIERPFETYKENIELKENDEKMKAMKRSRTWGQKCAPMSDLTDLKSLPDTELMKDTARGQNLLQTQDHAKAPKSEKGKITKMPCQSLQPEPINTPTHTKQQLKASLGKVGVKEELLAVGKFTRTSGETTHTHREPAGDGKSIRTFKESPKQILDPAARVTGMKKWPRTPKEEAQSLEDLAGFKELFQTPGPSEESMTDEKTTKIACKSPPPESVDTPTSTKQWPKRSLRKADVEEEFLALRKLTPSAGKAMLTPKPAGGDEKDIKAFMGTPVQKLDLAGTLPGSKRQLQTPKEKAQALEDLAGFKELFQTPGHTEELVAAGKTTKIPCDSPQSDPVDTPTSTKQRPKRSIRKADVEGELLACRNLMPSAGKAMHTPKPSVGEEKDIIIFVGTPVQKLDLTENLTGSKRRPQTPKEEAQALEDLTGFKELFQTPGHTEEAVAAGKTTKMPCESSPPESADTPTSTRRQPKTPLEKRDVQKELSALKKLTQTSGETTHTDKVPGGEDKSINAFRETAKQKLDPAASVTGSKRHPKTKEKAQPLEDLAGWKELFQTPVCTDKPTTHEKTTKIACRSQPDPVDTPTSSKPQSKRSLRKVDVEEEFFALRKRTPSAGKAMHTPKPAVSGEKNIYAFMGTPVQKLDLTENLTGSKRRLQTPKEKAQALEDLAGFKELFQTRGHTEESMTNDKTAKVACKSSQPDLDKNPASSKRRLKTSLGKVGVKEELLAVGKLTQTSGETTHTHTEPTGDGKSMKAFMESPKQILDSAASLTGSKRQLRTPKGKSEVPEDLAGFIELFQTPSHTKESMTNEKTTKVSYRASQPDLVDTPTSSKPQPKRSLRKADTEEEFLAFRKQTPSAGKAMHTPKPAVGEEKDINTFLGTPVQKLDQPGNLPGSNRRLQTRKEKAQALEELTGFRELFQTPCTDNPTTDEKTTKKILCKSPQSDPADTPTNTKQRPKRSLKKADVEEEFLAFRKLTPSAGKAMHTPKAAVGEEKDINTFVGTPVEKLDLLGNLPGSKRRPQTPKEKAKALEDLAGFKELFQTPGHTEESMTDDKITEVSCKSPQPDPVKTPTSSKQRLKISLGKVGVKEEVLPVGKLTQTSGKTTQTHRETAGDGKSIKAFKESAKQMLDPANYGTGMERWPRTPKEEAQSLEDLAGFKELFQTPDHTEESTTDDKTTKIACKSPPPESMDTPTSTRRRPKTPLGKRDIVEELSALKQLTQTTHTDKVPGDEDKGINVFRETAKQKLDPAASVTGSKRQPRTPKGKAQPLEDLAGLKELFQTPICTDKPTTHEKTTKIACRSPQPDPVGTPTIFKPQSKRSLRKADVEEESLALRKRTPSVGKAMDTPKPAGGDEKDMKAFMGTPVQKLDLPGNLPGSKRWPQTPKEKAQALEDLAGFKELFQTPGTDKPTTDEKTTKIACKSPQPDPVDTPASTKQRPKRNLRKADVEEEFLALRKRTPSAGKAMDTPKPAVSDEKNINTFVETPVQKLDLLGNLPGSKRQPQTPKEKAEALEDLVGFKELFQTPGHTEESMTDDKITEVSCKSPQPESFKTSRSSKQRLKIPLVKVDMKEEPLAVSKLTRTSGETTQTHTEPTGDSKSIKAFKESPKQILDPAASVTGSRRQLRTRKEKARALEDLVDFKELFSAPGHTEESMTIDKNTKIPCKSPPPELTDTATSTKRCPKTRLRKEVKEELSAVERLTQTSGQSTHTHKEPASGDEGIKVLKQRAKKKPNPVEEEPSRRRPRAPKEKAQPLEDLAGFTELSETSGHTQESLTAGKATKIPCESPPLEVVDTTASTKRHLRTRVQKVQVKEEPSAVKFTQTSGETTDADKEPAGEDKGIKALKESAKQTPAPAASVTGSRRRPRAPRESAQAIEDLAGFKDPAAGHTEESMTDDKTTKIPCKSSPELEDTATSSKRRPRTRAQKVEVKEELLAVGKLTQTSGETTHTDKEPVGEGKGTKAFKQPAKRKLDAEDVIGSRRQPRAPKEKAQPLEDLASFQELSQTPGHTEELANGAADSFTSAPKQTPDSGKPLKISRRVLRAPKVEPVGDVVSTRDPVKSQSKSNTSLPPLPFKRGGGKDGSVTGTKRLRCMPAPEEIVEELPASKKQRVAPRARGKSSEPVVIMKRSLRTSAKRIEPAEELNSNDMKTNKEEHKLQDSVPENKGISLRSRRQNKTEAEQQITEVFVLAERIEINRNEKKPMKTSPEMDIQNPDDGARKPIPRDKVTENKRCLRSARQNESSQPKVAEESGGQKSAKVLMQNQKGKGEAGNSDSMCLRSRKTKSQPAASTLESKSVQRVTRSVKRCAENPKKAEDNVCVKKIRTRSHRDSEDI

SEQ ID NO: 22 - DNA, 4448 bp, Homo sapiens
  misc_feature: Incyte ID No: 238349.2
  unsure 3750-3915: a, t, c, g, or other
ccgctcgagggcgtctccggctgctcccattgagctgtctgctcgctgtgcccgctgtgcctgctgtgcccgcgctgtcgccgctgctaccgcgtctgctggacgcgggagacgccagcgagctggtgattggagccctgcggagagctcaagcgcccagctctgccccaggagcccaggctgccccgtgagtcccatagttgctgcaggagtggagccatgagctgcgtcctgggtggtgtcatccccttggggctgctgttcctggtctgcggatcccaaggctacctcctgcccaacgtcactctcttagaggagctgctcagcaaataccagcacaacgagtctcactcccgggtccgcagagccatccccagggaggacaaggaggagatcctcatgctgcacaacaagcttcggggccaggtgcagcctcaggcctccaacatggagtacatgacctgggatgacgaactggagaagtctgctgcagcgtgggccagtcagtgcatctgggagcacgggcccaccagtctgctggtgtccatcgggcagaacctgggcgctcactggggcaggtatcgctctccggggttccatgtgcagtcctggtatgacgaggtgaaggactacacctacccctacccgagcgagtgcaacccctggtgtccagagaggtgctcggggcctatgtgcacgcactacacacagatagtttgggccaccaccaacaagatcggttgtgctgtgaacacctgccggaagatgactgtctggggagaagtttgggagaacgcggtctactttgtctgcaattattctccaaaggggaactggattggagaagccccctacaagaatggccggccctgctctgagtgcccacccagctatggaggcagctgcaggaacaacttgtgttaccgagaagaaacctacactccaaaacctgaaacggacgagatgaatgaggtggaaacggctcccattcctgaagaaaaccatgtttggctccaaccgagggtgatgagacccaccaagcccaagaaaacctctgcggtcaactacatgacccaagtcgtcagatgtgacaccaagatgaaggacaggtgcaaagggtccacgtgtaacaggtaccagtgcccagcaggctgcctgaaccacaaggcgaagatctttggaactctgttctatgaaagctcgtctagcatatgccgcgccgccatccactacgggatcctggatgacaagggaggcctggtggatatcaccaggaaccgggaaggtctcccttcttcgtgaagtctgagagacccggcgtgcagtccctcagcaaatacaaaccttccagctcattcatggtgtcaaaagtgaaagtgcaggatttggactgctacacgaccgttgctcagctgtgcccgtttgaaaagccagcaactcactgcccaagaatccattgtccggcacactgcaaagacgaaccttcctactgggctccggtgtttggaaccaacatctatgcagatacctcaagcatctgcaagacagccgtgcacgcgggagtcatcagcaacgagagtgggggtgacgtggacgtgatgcccgtggataaaaagaagacctacgtgggctcgctcaggaatggagttcagtctgaaagcctggggactcctcgggatggaaaggccttccggatctttgctgtcaggcagtgaatttccagcaccaggggagaaggggcgtcttcaggagggcttcggggttttgcttttatttttattttgtcattgcggggtatatggagagtcaggaaacttcctttgactgatgttcagtgtccatcactttgtggcctgtgggtgaggtgacatctcatcccctcactgaagcaacagcatcccaaggtgctcagccggactccctggtgcctgatcctgctggggcctgggggtctccatctggacgtcctctctcctttagagatctgagctgtctcttaaaggggacagttgcccaaaatgttccttgctatgtgttcttctgttggtggaggaagttgatttcaacctccctgccaaaagaacaaaccatttgaagctcacaattgtgaagcattcacggcgtcggaagaggccttttgagcaagcgccaatgagtttcaggaatgaagtagaaggtagttatttaaaaataaaaaacacagtccgtccctaccaatagaggaaaatggttttaatgtttgctggtcagacagacaaatgggctagagtaagagggctgcgggtatgagagaccccggctccgccctggcacgtgtccttgctggcggcccgccacaggcccccttcaatggccgcattcaggatggctctatacacagcagtgctggtttatgtagagttcagcagtcacttcagagatgtatcttgtctttgtcaggcccttcgtcttcatggcccacctgttttctgccgtgacctttggtcccattgaggactaaggatcgggaccctttctttaccccctacccgttgtggctcccaccctgcctcggactggtttacgtgtcctggttcacacccaggacttttctttgcaagcgaacctgtttgaagcccaagtcttaactcctggtctcgtaaggttccactgagacgagatgtctgagaacaaccaaagaaggcctgctctttgctgcttttaaaaaatgacaattaaatgtgcagattccccacgcacccgatgacctattttttcagccgtgggaggaatggagtctttggtacattcctcaccgaggttagcagctcagtttgtggttatgaaaccgtctgtggcctcatgacagcgagagatgggaatacactagaaggatctcttttcctgttttcgtgaaacgactcttgccaaacgttcccgaggcgccaaggagtgtagtacaccctggctgccatcactctataaaagtgcttcatgagcccagaccaaaagcccacagtgaaatgaagtacccttttgtaaatagcatttttttgcagaaggtgaaaattccactctctaccaccgggccagccaatagatcactttggtgaatgctagtttcaaatttgattcaaaatatttcttaggtgaaagaactagcagaaagtcaaaaactaagatactgtagactggacaagaaattctacctgggcacctaggtgatgccttctttctttgattgcctttctaataaatgcagaatctgaaggtaaataggtttaaaacaaaacaaaaacccacccctttaaggagttggtaaaaagcagttcaactcttagcttgactgagctaaaattcacaggactacgtgctttgtgcattgtagtctagtcgtaattcataggtactgactcctcagccccaaatgtcggagaggaagaattcggtcagcctgtcaggtcgtgagtccagttaccaccaaacatctgggaaacttctgggtgctgggtgctctgctgctggacttttgtggctgtgtctgtgtctgcaagataaattagatcgccctgtggggtttgcagaattagtgaagggtccaggacgatcccagtgggctcgcttccaaagcatcccactcaagggagacttgaaacttccagtgtgagttgaccccatcatttaaaaataaagtccccgggttccttaatgcctccttcactgggccttcctagcaggatagaaagtccttgcccagagcaggacctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcccggccatggacctggctgtctttatcatccccacaaacattttgaaactggaatatttgtcttcagaaaatggaaacaagactataaatgataagccctgtccctagcaccacctctcctgtgtgtggaatagaggcccctcgtgctaccaacacttaccctgtgtttaaaaagatcttgtaccaagccaacggcgttcctggctctcctgcccacaggatgaacattttcggcttccttaggagttttgccctaccgtattccaaagcgtgtgctggtttctcatattgtctgtaggctcactcagcccgcagtttatgtgtgtgcttttttctatgaaaaatgatgtattttgctacttcctgtgtacaaagttttattgtaaatgttttttgtgctttgcatgaacaggggccacgttgttgcaattgtttcagtagaactggtttgatttctaaaatgttcctgtaacatatcttttatgaacaaatctgaacaatttgtgaaataaaacattgaaaaccatc

SEQ ID NO: 23 - DNA, 110 bp, Homo sapiens
  misc_feature: Incyte ID No: 238349.4c
cggcacgaggtaaatgttttttgtgctttgcatgaacaggggccacgttgttgcaattgtttcagtagaactggtttgatttctaaaatgttcctgtaacatatctttta

SEQ ID NO: 24 - DNA, 1228 bp, Homo sapiens
  misc_feature: Incyte ID No: 402917.3c
gaggagacagtgtccaggatccaggggcagggctcctgtgtctccctcactgtcgtcgaccctgaggcggaccgcttcttcagcatggttcgcctgtccccactcctcttcttggagaacacagaggctcccgcctccccccagggcagcagctcagcctcactggttgagacagaggacccttcacttgaagacacaagcgtgccttctgtccctcttggctcccgacagtgcttcctgtaccctgggcctggtggcagctatggcttccgactcagttgtgtggccagtgggcctcgtctcttcatctcccaggtgactccaggaggctcagctgcccgggctgggctgcaagtgggagacgtgattctggaagtgaacgggtatcctgttgggggacagaatgacctggagaggcttcagcagctgcctgaggctgagccacccctctgcctgaagctggcagccaggtctctgcggggcttggaagcctggattccccctggggctgcagaggactgggctctggcctcggatctactgtagagcacccctgcttggtacagacatactcaggggctaccgtgtcttcactctccagcctgaggtggtgaaggcaggatgctctctctaagccagaccagagggactcagacaccaccgatcacaggctggcccaggtgctccctcccttcctgcaggcccacctgccagcagagggtgtggttggaggcctcagacaggtccctgaaggagtctgaggctccagaggatgtcatatgggagttttagagagctgtgtcccaaggatgaaggtgtggctgtgggtctggctaggattgaagccatctggaccttttctagatatgactccaggacccttgagtgtaatgcaaaaatttggagaccagctatgcctgccctctgtgggtgccttagcattgcgggagggtggtgcttggtcaccgttgcatttgttatagaaatggccattcgccataaatctgactgcctgtgtttgtgttggtgggggtaaggggcagtggtgtgaagggaccaaaagggcctcaggctcaaggggtgggatgcggctcctgcaggagagaggttgagacctggtcaaatttatttcctatcaatcactgaatctcagggataatgggtcaacccagaactgagatgtctgtatgacagccactcctaacaatatacaacaacaaatccatat

SEQ ID NO: 25 - DNA, 1216 bp, Homo sapiens
  misc_feature: Incyte ID No: 406330.1
gttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagtcctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctg

SEQ ID NO: 26 - DNA, 935 bp, Homo sapiens
  misc_feature: Incyte ID No: 2516070CB1
ccctggctgcagacataaataggccctgcaagagctggctgcttagagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggcacgcgtgcgcacgcatctggccccctacagcgacgagctgcgccagcgcttggctgcgcgccttgaggctctcaaggagaacggcggcgccagactggccgagtaccacgccaaggccaccgagcatctgagcacgctcagcgagaaggctaagcctgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttcgca

SEQ ID NO: 27 - protein, 267 aa, Homo sapiens
  misc_feature: Incyte ID No: 2516070CD1
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVARVRTHLAPYSDELRQRLAARLEALKENGGARLAEYHAKATEHLSTLSEKAKPALEDLRQGLLPVLESFKVSFLSALEEYTKKLNTQ

SEQ ID NO: 28 - DNA, 1656 bp, Homo sapiens
  misc_feature: Incyte ID No: 167507CB1
cctagcagagccatttaacctttgggaacaaggcaactagcgtctggcagcaggaatccaaccagtgccctgagttctgaggcagagaggaggacagaagaaacaagaggctggagattgtcaaattcagtatcccagttggctcttgattcttggtgaaaccatccctcagctcctagagggagattgttagatcatgaaactaattaccatccttttcctctgctccaggctgctactaagtttaacccaggaatcacagtccgaggaaattgactgcaatgacaaggatttatttaaagctgtggatgctgctctgaagaaatataacagtcaaaaccaaagtaacaaccagtttgtattgtaccgcataactgaagccactaagacggttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcatgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaaaaaaaaaaaaaaa

SEQ ID NO: 29 - protein, 427 aa, Homo sapiens
  misc_feature: Incyte ID No: 167507CD1
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 30 - DNA, 617 bp, Homo sapiens
  misc_feature: Incyte ID No: 3860413CB1
gcccagcccaggaacgcgggcggtgcggactcagcgggccgggtgcaggcgcggactgggcctctgcgcccggcccgacctccgtctataaatagagcagccagttgcagggctccattctgctttccaactgcctgactgcttgttcgtctcactggtgtgagctccagcatcccctttgctataaacactgcttgccgcgctgcactccaccacgcctcctccaagtcccagcgaacccgcgtgcaacctgtcccgactctagccgcctcttcagctcgccatggatcccaactgctcctgcgccgccggtgactcctgcacctgcgccggctcctgcaaatgcaaagagtgcaaatgcacctcctgcaagaaaagctgctgctcctgctgccctgtgggctgtgccaagtgtgcccagggctgcatctgcaaaggggcgtcggacaagtgcagctgctgcgcctgatgctgggacagccccgctcccagatgtaaagaacgcgacttccacaaacctggattttttatgtacaaccctgaccgtgaccgtttgctatattcctttttctatgaaataatgtgaatgataataaaacagctttgacttgaaaaaa

SEQ ID NO: 31 - protein, 61 aa, Homo sapiens
  misc_feature: Incyte ID No: 3860413CD1
MDPNCSCAAGDSCTCAGSCKCKECKCTSCKKSCCSCCPVGCAKCAQGCICKGASDKCSCCA

SEQ ID NO: 32 - DNA, 1629 bp, Homo sapiens
  misc_feature: Incyte ID No: 3393861CB1
gatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaggcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagttttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatatagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaagaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaataagcaa

SEQ ID NO: 33 - protein, 488 aa, Homo sapiens
  misc_feature: Incyte ID No: 3393861CD1
MVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSFDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMKKMSMKIRPFFPQQ

SEQ ID NO: 34 - DNA, 852 bp, Homo sapiens
  misc_feature: Incyte ID No: 2517374CB1
agacacagagtaaacttttgctgggctccaagtgaccgcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccggatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggttcaggacagagacttgggggccatcctgcccctccaacccgacatgtgtacctcagctttttccctcacttgcatcaataaagcttctgtgtttggaacagctaaaaaaaaaaa

SEQ ID NO: 35 - protein, 201 aa, Homo sapiens
  misc_feature: Incyte ID No: 2517374CD1
MALSWVLTVLSLLPLLEAQIPLCANLVPVPITNATLDRITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 36 - DNA, 483 bp, Homo sapiens
  misc_feature: Incyte ID No: 030850.7
ctggatggagcaggaaaaaccagtgtcctgcactctctagcttcaaacagagtccagcacagtgtggcacccacccaaggtttccatgcagtttgcatcaacactgaagacagccagatggagttcctggagaatcacagccgattacctgaagccaagaaataccttcatcagctaattgcagcaaacccagtacttcctctggttgtgtttgcaaacaaacaggatcttgaagcagcctatcacattacagatatccatgaagctttggcattatctgaagtgggaaatgacaggaagatgttcttgtttggaacctacctgactaagaatggctcagagataccctccaccatgcaagatgccaaagacttgattgcacagctggctgcagatgtgcagtgaccaggactcagcccactgtgcggctcacgactgagatgtcatcagtgttgaatggcaggcttgaagccaaaggtttcc

SEQ ID NO: 37 - DNA, 567 bp, Homo sapiens
  misc_feature: Incyte ID No: 237416.12c
  unsure 33, 483, 500: a, t, c, g, or other
tgaataaaaacttaactaacaatcacgtaaggntctcataggtgacaaccagttacttttcttgtttcttctccccaacagtgaatcatcaaggccatggtgcttaaacacaagtgtattcctttcacgtcttactactctccaaatcggagtccatcacttcacttcagttattcattaaggggttcctctacagctttcctaggaggttgtatagtcttctgattggaagctgatataaataacaaataagaatataaatttaataaatgaaataaactaaggcatttggtaatgtttaattttaagataaaatgttcagggctaaaactaaaggtgccagagatgttaatgaaagagttccagctctgacagtctattcaaacatgctgaatattcttgattatatacactgatttgaaaaatgaagcaaataacccatctacatcaaatagtaaacacattctctcatttgtttatccnaattttcccccaaatcngccacttgttacactggctggtgggaaaatgctgtcaccaacatacccccaccatgggtgctccatc

SEQ ID NO: 38 - DNA, 1003 bp, Homo sapiens
  misc_feature: Incyte ID No: 237416.14
atagcattttacctaaagtagaacttcttttataattggagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagcagtgagctaagggagatggagtagtggggacaaattctggcacattctgtctacactctgggtagatagaggagggaggatggagcacccatggtgggggtatgttggtgacagcattttcccaccagccagtgtaacaagtggctgatttgggggaaagatggcataaacaaatgagagaatgtgtttactatttgatgtagatgggttatttgcttcatttttcaaatcagtgtatataatcaagaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctaggaataactgaagtgaagtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttactacaataattatgatct

SEQ ID NO: 39 - DNA, 6868 bp, Homo sapiens
  misc_feature: Incyte ID No: 1269631CB1
ccggcccagcggctctcctggcctcgcgctgcacattctctcctggcggcggcgccacctgcagtagcgttcgcccgaacatggcgacacggagcagcaggagggagtcgcgactcccgttcctattcaccctggtcgcactgctgccgcccggagctctctgcgaagtctggacgcagaggctgcacggcggcagcgcgcccttgccccaggaccggggcttcctcgtggtgcagggcgacccgcgcgagctgcggctgtgggcgcgcggggatgccaggggggcgagccgcgcggacgagaagccgctccggaggaaacggagcgctgccctgcagcccgagcccatcaaggtgtacggacaggttagtctgaatgattcccacaatcagatggtggtgcactgggctggagagaaaagcaacgtgatcgtggccttggcccgagatagcctggcattggcgaggcccaagagcagtgatgtgtacgtgtcttacgactatggaaaatcattcaagaaaatttcagacaagttaaactttggcttgggaaataggagtgaagctgttatcgcccagttctaccacagccctgcggacaacaagcggtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacacgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggccattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaagaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcatcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaaaacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcaattgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctgaaagagctttcctcactagaaaccaaatggtgtaaatattttatttgataaagatagttgatggtttattttaaaagatgcactttgagttgcaatatgttatttttatatgggccaaaaacaaaaaacaaaaaaaaaaaaaaa

SEQ ID NO: 40 - protein, 2214 aa, Homo sapiens
  misc_feature: Incyte ID No: 1269631CD1
MATRSSRRESRLPFLFTLVALLPPGALCEVWTQRLHGGSAPLPQDRGFLVVQGDPRELRLWARGDARGASRADEKPLRRKRSAALQPEPIKVYGQVSLNDSHNQMVVHWAGEKSNVIVALARDSLALARPKSSDVYVSYDYGKSFKKISDKLNFGLGNRSEAVIAQFYHSPADNKRYIFADAYAQYLWITFDFCNTLQGFSIPFRAADLLLHSKASNLLLGFDRSHPNKQLWKSDDFGQTWIMIQEHVKSFSWGIDPYDKPNTIYIERHEPSGYSTVFRSTDFFQSRENQEVILEEVRDFQLRDKYMFATKVVHLLGSEQQSSVQLWVSFGRKPMRAAQFVTRHPINEYYIADASEDQVFVCVSHSNNRTNLYISEAEGLKFSLSLENVLYYSPGGAGSDTLVRYFANEPFADFHRVEGLQGVYIATLINGSMNEENMRSVITFDKGGTWEFLQAPAFTGYGEKINCELSQGCSLHLAQRLSQLLNLQLRRMPILSKESAPGLIIATGSVGKNLASKTNVYISSSAGARWREALPGPHYYTWGDHGGIITAIAQGMETNELKYSTNEGETWKTFIFSEKPVFVYGLLTEPGEKSTVFTIFGSNKENVHSWLILQVNATDALGVPCTENDYKLWSPSDERGNECLLGHKTVFKRRTPHATCFNGEDFDRPVVVSNCSCTREDYECDFGFKMSEDLSLEVCVPDPEFSGKSYSPPVPCPVGSTYRRTRGYRKISGDTCSGGDVEARLEGELVPCPLAEENEFILYAVRKSIYRYDLASGATEQLPLTGLRAAVALDFDYEHNCLYWSDLALDVIQRLCLNGSTGQEVIINSGLETVEALAFEPLSQLLYWVDAGFKKIEVANPDGDFRLTIVNSSVLDRPRALVLVPQEGVMFWTDWGDLKPGIYRSNMDGSAAYHLVSEDVKWPNGISVDDQWIYWTDAYLECIERITFSGQQRSVILDNLPHPYAIAVFKNEIYWDDWSQLSIFRASKYSGSQMEILANQLTGLMDMKIFYKGKNTGSNACVPRPCSLLCLPKANNSRSCRCPEDVSSSVLPSGDLMCDCPQGYQLKNNTCVKEENTCLRNQYRCSNGNCINSIWWCDFDNDCGDMSDERNCPTTICDLDTQFRCQESGTCIPLSYKCDLEDDCGDNSDESHCEMHQCRSDEYNCSSGMCIRSSWVCDGDNDCRDWSDEANCTAIYHTCEASNFQCRNGHCIPQRWACDGDTDCQDGSDEDPVNCEKKCNGFRCPNGTCIPSSKHCDGLRDCSDGSDEQHCEPLCTHFMDFVCKNRQQCLFHSMVCDGIIQCRDGSDEDAAFAGCSQDPEFHKVCDEFGFQCQNGVCISLIWKCDGMDDCGDYSDEANCENPTEAPNCSRYFQFRCENGHCIPNRWKCDRENDCGDWSDEKDCGDSHILPFSTPGPSTCLPNYYRCSSGTCVMDTWVCDGYRDCADGSDEEACPLLANVTAASTPTQLGRCDRFEFECHQPKTCIPNWKRCDGHQDCQDGRDEANCPTHSTLTCMSREFQCEDGEACIVLSERCDGFLDCSDESDEKACSDELTVYKVQNLQWTADFSGDVTLTWMRPKKMPSASCVYNVYYRVVGESIWKTLETHSNKTNTVLKVLKPDTTYQVKVQVQCLSKAHNTNDFVTLRTPEGLPDAPRNLQLSLPREAEGVIVGHWAPPIHTHGLIREYIVEYSRSGSKMWASQRAASNFTEIKNLLVNTLYTVRVAAVTSRGIGNWSDSKSITTIKGKVIPPPDIHIDSYGENYLSFTLTMESDIKVNGYVVNLFWAFDTHKQERRTLNFRGSILSHKVGNLTAHTSYEISAWAKTDLGDSPLAFEHVMTRGVRPPAPSLKAKAINQTAVECTWTGPRNVVYGIFYATSFLDLYRNPKSLTTSLHNKTVIVSKDEQYLFLVRVVVPYQGPSSDYVVVKMIPDSRLPPRHLHVVHTGKTSVVIKWESPYDSPDQDLLYAIAVKDLIRKTDRSYKVKSRNSTVEYTLNKLEPGGKYHIIVQLGNMSKDSSIKITTVSLSAPDALKIITENDHVLLFWKSLALKEKHFNESRGYEIHMFDSAMNITAYLGNTTDNFFKISNLKMGHNYTFTVQARCLFGNQICGEPAILLYDELGSGADASATQAARSTDVAAVVVPILFLILLSLGVGFAILYTKHRRLQSSFTAFANSHYSSRLGSAIFSSGDDLGEDDEDAPMITGFSDDVPMVIA

SEQ ID NO: 41 - DNA, 2167 bp, Homo sapiens
  misc_feature: Incyte ID No: 961189CB1
cgcgagctgtctcggtcccacgtgtgcgagttgctacgatggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcacccaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacatgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgcaaacaaagtcaaagctgcactgaaaagcttgattcctacattggaaaaaaccaaaagcaccagcaaaggaatagaaattctacttgaaaaactgagcacataggtggaaagagttaagagcaagatggaatgattttttctgttctctgttctgtttcccaatgcagaaaagaaggggtagggtccaccatactggtaattggggtactctgtatatgtgtttcttctttgtatacgaatctatttatataaattgtttttttaaatggtaaaaaaaaaaaaaaa

SEQ ID NO: 42 - protein, 648 aa, Homo sapiens [sequence omitted]

SEQ ID NO: 43 - DNA, 434 bp, Homo sapiens
  misc_feature: Incyte ID No: 246946.1
gtcgaatccaaatcactcattgtgaaagctgagctcacagccgaataagccaccatgaggctgtcagtgtgtctcctgatggtctcgctggccctttgctgctaccaggcccatgctcttgtctgcccagctgttgcttctgagatcacagtcttcttattcttaagtgacgctgcggtaaacctccaagttgccaaacttaatccacctccagaagctcttgcagccaagttggaagtgaagcactgcaccgatcagatatcttttaagaaacgactctcattgaaaaagtcctggtggaaatagtgaaaaaatgtggtgtgtgacatgtaaaaatgctcaacctggtttccaaagtctttcaacgacaccctgatcttcactaaaaattgtaaaggtttcaacacgttgctttaataaatcacttgccctgc

SEQ ID NO: 44 - DNA, 259 bp, Homo sapiens
  misc_feature: Incyte ID No: 017958.1
ggggacaacctaaaaggtcaagaatagggaagaaagttaaattaccagcacactattgcactgatttattggaatgctatgtggccataaaatgacattgcaaaagaatatttagtagatgggaaaaatattcactacatattaagcacacacaaaaataatgcatgcatcatgatttacgtatgtttctaggatgttatatgactagtagagtacatactgaaatgtcggttggttatctctggctgctgccattatg

SEQ ID NO: 45 - DNA, 1308 bp, Homo sapiens
  misc_feature: Incyte ID No: 985556.1
  unsure 905: a, t, c, g, or other
ggcaaaattggagctgtccaggccaggacaccccgatgtccagggcttccatacgaacaggcacatgggctgggaagtacatgaggcccctgggtagaagggtctgtcagttctctcctcccttgccctctgggagggtcctcctaacatagcttccaggaggtgggaggagcagttactgtcagcaggtgtcagccaggtgtcagcttctcctggggatctctagatgtctgcttgtgatttttggcaagtatatgcaaatgagcctcctctcctgccctgagacaagtatctgcagtgtgaacctggcagcctcagacccaaggggctcagaggaaacttctctggtttctagagctctgtgctccttcagagaagtcttccttccttccagtcagtgtccctgtgaagctgggatactcatttcctgtgtaccgggcaaacaccggattgctgattttgagaaatgcctctcgatggacctgtaacctgctggagtctgggatggtagctgtgggctggacttggctgatgggatgacccggtggctagtgcagcatcacacaagcctggttcaagtcttggctgtgtcatttcctgctgagggaccaggcactgaatttcctacctcttagggtcattacctatgaggttaaagctacctcatgggattgttatacgccactaatgttgaggcagacacctcttggcagggtgactgctcatcttagaccctccccttttctgcgaatttgggccccttgatcctctgatgggagctgaaaggatgagaggtgggcatctagatttagggaggctgttcaggctttgcaggtcccttacctgaacacatagaaaccctggagctgtgactgtgtccatgtgtgtgtgtttgtctgtgtgtnttgcgggggatgggcacctgcatgaatgtggtagagaaaatggctctgctcagagggaagatacgcatagcaaggcagggaccagaggaatcacaggcgcctggagagcagccgggcaccgcctccagggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaatt

SEQ ID NO: 46 - DNA, 2523 bp, Homo sapiens
  misc_feature: Incyte ID No: 476301CB1
ctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccggccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagccttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaaccaaaaaaaaaaaaaa

SEQ ID NO: 47 - protein, 596 aa, Homo sapiens
  misc_feature: Incyte ID No: 476301CD1
MADAEARAEFPEEARPDRGTLQVLQDMASRLRIHSIRATCSTSSGHPTSCSSSSEIMSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 48 - DNA, 2492 bp, Homo sapiens
  misc_feature: Incyte ID No: 996427.2
aatcactcattttccttttctgactgaattaagggagattatatgaattgtttataaaataggtctctggtacacatttgttgttcactttaatgattttttcactaaccccacctgttatttttagactgactcttatcataagttttgcctttataaattctgagttaaataaaatgaccaattgtagtcatgaccaggcatgaagattccatccctgaggggtaaagcagtagactactgccagctccacttcagttcaggccacatcaccctcagtcctgaaggagaccccttcttagcctccagttgttgcactgcaactctgcctcgaattgggctatgcccgagtatcctcagagtttagatgggcagtgtatttttgcttaagtagaagaatgtagttgtgccactgagaaggataaccagaaaaggttagatatatttgtcagttcacttttactcaaatttccattgagttacttaagaaatcagttcttcaaagtggatatgtacattacagactctgtcacctacacatacacaggaatcttttgaagaataagatctgggtaatactggagtaggatgtaggaaggttaatgttgtatagatgatgttttaaagatagagtttcagcatatatgttaataactttttctcctattttctcaaggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcataaaa

SEQ ID NO: 49 - DNA, 902 bp, Homo sapiens
  misc_feature: Incyte ID No: 2989375CB1
cactgcactccagtctaggtgacagagaaggactcgtctcaaaaaataaaaataaataaaaaggaagcaaggctaatcatcagtatgtgcttgttacaagagctatgatgaaggcactccttcgagtttaaccaaatgagatcatctctgtcatgtgcctcacgcctcacagggactccatgtgtgaagattcccccttcactcaccagatcatctccatggcaacagcttgcagcctgctcttggagtgctttgttttggcagcttctctgctagtttgtgtatggagtgaatggaggaggtaaatccacagattaagaatatgctgtcaggagtcaggcagccaaggtcagaagccagctctgcttctcagtgctttctctttacaacacaggactttgcaaggaacatataattctgtgactagcgccatttggaaaatgttgaaactgaagtagagatgagagatcttacgtctgcctacccagtgagatacgaggaaggtcaagggaaaaaaaattccaagctcttctttatctgctataggaaatgaacattcaattttttgcatgcaacgacaagaggtcaaggaccccagaagccagcccgctacttccaagttgagagcccctggtcataccctccagttgagctcagatttgtcacaaatttacccctctcctttccttccattccccatgacctgcagagagagatgtcagataccttcctcttggcctcccatgggcatccataagaaacttacttgaagcaagaagcccagtataggtgtctgggcagttggacatttcctctagccagatctgtccgaatagagccatctgggtacatgacgcagagggcatttgataaataactggaaaagtcaataaatctttgtc

SEQ ID NO: 50 - protein, 50 aa, Homo sapiens
  misc_feature: Incyte ID No: 2989375CD1
MCLTPHRDSMCEDSPFTHQIISMATACSLLLECFVLAASLLVCVWSEWRR

SEQ ID NO: 51 - DNA, 618 bp, Homo sapiens
  misc_feature: Incyte ID No: 236359.2
  unsure 44, 57: a, t, c, g, or other
aagaattcgtcaaaggacacattttgtcattagcacttacaganagcaactacagcnagccctagattttcgaaactcttcagctacttgcccttttttatctgaaaccatcataccttctgaaagaaaaaagcatatcttcattgacataacagaagtgagatggcccagtcttgatacagatggtaccatgatatatatggagagtggcattgtgaagataacatctttagatggtcatgcatacctctgcctgcccagatctcagcatgaatttacagtacattttttgtgtaaagttagccagaagtcagactcatctgcagtgttgtcagaaacaaataataaagccccaaaagataaactagttgaaaaaactggcaaaatctgtatacgtggaaatttaccaggacagagactgaagaataaagaaaatgagtttcattgccagatcatgaaatccaaagaaactttaaagaagatgagttgtgtaaatggaactgaagggagggaagagctgccttcgcctggtacaaagcacacatgtgtatacacatgggtcaagcagtgctggtctgtggctgcctgtccagaggaatggaaatatcctttgtcttt

SEQ ID NO: 52 - DNA, 527 bp, Homo sapiens
  misc_feature: Incyte ID No: 011112.1c
atccctgccttcagtgggtgctatatatttagtatgagctttattcacttcctcttcctctcgtttgagtgcctgaaagaactgtggctgatgtctatagacatagaaaaatctaggagaatatgattcattgtctaaccccatcaaggggttacatattttaaataagacgtcatttctcctcttcactccagcatctcctccttcaaaggcatttttcaccctcttgaaattaatacgctctattcgctcttttcacctaaaaaaaggtcaatcgtcgctctgagaaacaacagtgagatgcaaaataagggtaaaatggcattgaaatgaatccctttgaaaaagtaagcggtttgctttatcagttaatggtctcatcagcgcttcagtttcctcttctgcaaaaatcagtctgttgaactagagcatatcaaaggttccttctagtgttttgattctaggacctctaaattcatgcaggctgcataatgcaaatttaacctgattaaagccttatttctcat

SEQ ID NO: 53 - DNA, 899 bp, Homo sapiens
  misc_feature: Incyte ID No: 198268.1
cagatttgggattaacaaacttccacttagacattctgcctgactgacctcaggcatttcgcactctgaatgtcaaacccaactcattgtcatctctgaagctgctcacttaattctcctctgtattctctttaacaacccagttgcccaacccagaaactgggagtcacgcagacctcctttctctcttactcccacacaatgagccatgaagtccagtctttctatcttaacatcactgtcaaacccacactgtattccatgcccagcgctgccacgtgaatgtactctgctcacttccttcctggattacccatagccccacctcatcctcctacccttgctttcctccctgaagtcagagagatcctactcaagagataactgctcctgacagcccttattacagaactgaagtactctccttagcttcagctctgtgcccacgtgccttggctttggatacaaggtactacagcactttgtccactctccaggcttacctgtgtcattccacatgcacatcttagaaaatgccagccttagagaattctccctagccccaaaatgtctttgcccagtgcaattccttcttcctgtattacccctttccctccttcacactatctgcctggctaattcttatttatccttagttcaagtatggccttttctgggaaggtgaccctccttggccaccccttgcatatactttgatgccctagggcacaccccctttatttccctcatagaaacagccttctgtaaattgttccatgacaacctgtatttcaatttgtaagaaatttgcatgtactgtgagctccccaacgtcaggagactgacccttttgatatcattgctaagcctcattaaatgaatgaatgaaaatgttaaaa

SEQ ID NO: 54 - DNA, 3575 bp, Homo sapiens
  misc_feature: Incyte ID No: 978740.3
cccggctagaagccggctgtcggtctccgtgtcgccgccgccgcccggcatcgctggagctggggcccccttttgcctgggagttttgtagtcgcctagggtcagcggtgacatcccaaagggcaggcccggcagccgccatggtggccaaggattaccccttctacctcacggtcaagagagcgaactgcagcctggagctacctccggccagcggtccggccaaggacgctgaggagcctagtaataaacgggtcaaacccctttcccgagtcacgtcgctagcaaacctcatcccgcccgtgaaggccacgccattaaagcgcttcagtcaaaccctgcagcgctccattagcttccgcagtgagagccgccctgacatcctcgccccccgaccctggtccagaaatgccgccccctcgagcacgaaacggagagatagcaagctgtggagtgagaccttcgatgtgtgcgtcaatcagatgcttacatccaaggaaatcaaacgtcaggaggcgatctttgagctttcccaaggagaagaagacttgatagaagacttgaaattagcaaaaaaggcctatcatgaccccatgctgaaactctccataatgacagaacaagagttgaatcaaatttttggaacactggactctctaattcctctacatgaagagctccttagtcagcttcgagatgttaggaagcctgatggctcgactgaacatgttggtcccatcctcgtgggctggctcccttgcctcagctcctatgatagctactgcagcaatcaagtagccgccaaagctctgctggaccacaaaaagcaagatcaccgagtccaggatttcctacagcgatgtttagaatccccctttagccgcaaactagatctctggaatttcctcgatattccaagaagccgcctggtaaaataccctctgcttctccgagaaatcttgaggcacacaccaaatgataatccagatcagcagcacttggaagaagctataaatatcattcagggaattgtggcagaaatcaacaccaagactggtgaatctgaatgccgctattataaagagcggcttctttacttggaagaaggccagaaagactccctgatcgacagctctcgagtcttgtgttgtcatggtgaactgaagaacaatcggggcgtgaaactgcatgttttcctgttccaagaagtgcttgtgatcactcgagccgtcacccacaatgagcagctttgctaccagctgtaccgtcagccaatccccgtgaaagacctcctgctggaagacctccaggatggagaagtgaggctgggtggctccctgcgaggggcattcagcaacaatgagagaattaaaaacttcttcagagtcagtttcaaaaatggatcccaaagtcagacccactcgctacaagccaatgacactttcaacaaacagcagtggcttaactgtattcgtcaagccaaagaaacagttttgtgtgctgccgggcaagctggggtgcttgactccgagggatcgttcctaaatcccaccaccgggagcagagagctacagggagaaacaaaacttgagcagatggaccaatcggacagtgagtcagactgtagtatggacacgagtgaggtcagcctcgactgtgagcgcatggaacagacagactcttcctgtgggaacagcaggcatggtgaaagtaacgtctgacagaagcatgtgcacttcgggaagcaggcctgcatcttacctgtacagtatttgcattccacagatggaacggtttggagaagcactttttcatacttttgtgaaagtatacatgttggcccagtctctcgtatctgtacctttgtccctagtactgtaactgccaatctgtctgtgtaagctggaatctgtggcaactattaccctgtgttgtatttcccaagtgtctggatggatggagaggtactcaaacaagttactttcagttgtcctgctggattttaaaaaaatagaaaaagaatctcaaaactactgttttacatagattgtttgaagagtccttcctcttgtgcttctgtaccactttcccagctcttagatgtggtagctaaagggcacggaatttagacggccttgtaaatagggcatgaggaactcatctgtgtattgggatggtattagagagagaatcaggaaagaccaactcatgaagtgaacttggtttgatcttactcaactagaaagcttgaaaacatccctggggattctgaaggcttaattttgcaaaggaggatgcattgtctgaactttgcaacttcatccagtgcaagtttgatgcaagaatgtattaggacataaaatagaggctgaccttaaaagggccaggacagaagcggctgccagctctgaatctttaactgaaatgcacatggcaccaggaggtgtctctcatagttggttgctagcctaaaacatcagaatagaacccaaagggcttaggaaggcctgccaggataacaagaaggccctgtattcattgtgtttcatctgcctaggcctactcattattttagagaatgaatgaagcaacaaggaagagagaccatgactctatcgatgacactgtttatagaaacacaggagaggaagaatttggaatgaaaagcacttcgtcagaaccttctgtgggagccattgagagaaaagcatggtccagtgccttctgagaaaggccagagctttgggctttcctgctctgcttttgggtcgtcaatttgccatctctggttctgtgctataatcagaattgtaattatgttctccagaggccaatttcattaactctgattaattagaatcagctagccagattagtaacctctttgtccagccttgatttacagtgcagggtaaagtgcagaccttaaaaacagctaagtacctagaagagctccctgcaagtgtaaatattaaggatgacctgtgcaaaattatacccacaccagcactagtggtaattattctaaattattgccaaaaagttttttttaatctgtctttcaagtttacagaaaagaaagcagtaaatgcattgatgtcattttattatgtacatatatcatgtgcattcaagctgtgtgacaagatatatcaatataaaaacaaggtatatactttattattttttgaaaacaaggatattgtgatcaattttaccctgtaaaacatatttctgtatttataggtcttaaacatgatgaattttttctattacaagtttatttaaaactgctttctcaagtcgttattgatacagcaagtgaacctgctgcagacagaagcagaggaaagccaagaacagcctttattggtgaagaaaagaatgaatgattctttgtaggcgccatcagccacttttagaagccatcagccagtgtgttgggaaaagaggtttgtcaagtgttggcctatgggaaggtggtcaatgaatgttttgatgaaatgaatgtttttgtataatggccttaaacttttctggaagtatttcaaataaattacattattaagtcaaaa

SEQ ID NO: 55 - DNA, 1025 bp, Homo sapiens
  misc_feature: Incyte ID No: 400197.1
  unsure 574-662, 749-830: a, t, c, g, or other
gtcagcgtactcccctgccagataaaccaggactcagtccgctgctaggatgcgtttcaatgaagacatctgacctgtgtggtatgtcttcagggcattgtagttgacagtagtaatgcaaggatctaccacagcctgtttaaaatatgaccagaaatgtggctgctggagtagctagatgaaatatagaccacactgataaaaaaaaatcttactctttttcccttcctgttatttattgccaacacccttttcaaggatctgtccttttggagaatttttgtactttgtctccttcctttttctgtttttctagcatgttctcatttaagaataagcaaactatggcctgcaagccaaatctgacctacaacctgtttttgtaaataaagctttattgtaacacagccatgcccatttgtttacatatcatctatggctgctttcatgcctagaatggcagagttgatttgagtacagttggcccctgtctctgtgggttccacattcatgatttagtcaacctcagataaaaaatatttgagggagaaaaaacaaaagtaatacaaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgtggagccctgaaatgggaggaggaaaaaagtatacaggtggatgtgtgtaggttgtatgtaaatactacactgttttataannnnnnnnnnnnnnnnnnnnnnnnnnnnnnnnnnnnnnnnnnnnnnnnnnnnnnnnnnnnnnnnnnnnnnnnnnnnnnnnnnactgtagttgtcacagagaccatattactcacagtgcctaaaatatttactcttttacataaaaagtttgccgccttctacttctcttactatttctagcaaagtaccagactaatttctccttcctctctccctccaatttgtcacgaacaaacttttgtgcgtgtgtataaaatacaatatacacaaattacc

SEQ ID NO: 56 - DNA, 586 bp, Homo sapiens
  misc_feature: Incyte ID No: 235687.5c
  unsure 5, 45, 49, 127, 133, 159: a, t, c, g, or other
tgatnagaatgtgcacaaacccatcagtttaggttgttcacacantgtntgcaagggcctgcttgaataaacttcatcgaaaagcttgtccttttgaccagactgccatcaacacagatattgatgncacttncctgtcaacttcgcactaactccagntagttggagcccaggtaccagatcatcagtcaattaagttaagtaatctaggtgagaataaacactatgaggttgcaaagaaatgcgttgaggatttggcactctacttaaaaccactaagtggaggtaaaggtgtagctagcttgaaccagagtgcactgagccgtccaatgcaaaggaaactggtgacacttgtaaactgtcaactggtggaggaagaaggtcgtgtaagagccatgcgagcagctcgttcccttggagaaagaactgtaacagaactgatattacagcaccagaaccctcagcagttgtctgccaatctatgggccgctgtcagggctcgaggatgccagtttttagggccagctatgcaagaagaggccttgaagctggtgtactggcattagaagatggttctgccctctca

SEQ ID NO: 57 - DNA, 2660 bp, Homo sapiens
  misc_feature: Incyte ID No: 2797839CB1
gtggcgagtgccggccgaaagctaggtccggattgcacgtggagggccgcccgaagggcactctcggacattaacccgcattctgtaccatggggcgcaagttggaccctacgaaggagaagcgggggccaggccgaaaggcccggaagcagaagggtgccgagacagaactcgtcagattcttgcctgcagtaagtgacgaaaattccaagaggctgtctagtcgtgctcgaaagagggcagccaagaggagattgggctctgttgaagcccctaagacaaataagtctcctgaggccaaaccattgcctggaaagctaccaaaagggatctctgcaggagctgtccagacagctggtaagaagggaccccagtccctatttaatgctcctcgaggcaagaagcgcccagcacctggcagtgatgaggaagaggaggaggaagactctgaagaagatggtatggtgaaccacggggacctctggggctccgaggacgatgctgatacggtagatgactatggagctgactccaactctgaggatgaggaggaaggtgaagcgttgctgcccattgaaagagctgctcggaagcagaaggcccgggaagctgctgctgggatccagtggagtgaagaggagaccgaggacgaggaggaagagaaagaagtgacccctgagtcaggccccccaaaggtggaagaggcagatgggggcctgcagatcaatgtggatgaggaaccatttgtgctgccccctgctggggagatggagcaggatgcccaggctccagacctgcaacgagttcacaagcggatccaggatattgtgggaattctgcgtgattttggggctcagcgggaggaagggcggtctcgttctgaatacctgaaccggctcaagaaggatctggccatttactactcctatggagacttcctgcttggcaagctcatggacctcttccctctgtctgagctggtggagttcttagaagctaatgaggtgcctcggcccgtcaccctccggaccaataccttgaaaacccgacgccgagaccttgcacaggctctaatcaatcgtggggttaacctggatcccctgggcaagtggtcaaagactggactagtggtgtatgattcttctgtgcccattggtgctacccccgagtacctggctgggcactacatgctgcagggagcctccagcatgttgcccgtcatggccttggcaccccaggaacatgagcggatcctggacatgtgttgtgcccctggaggaaagaccagctacatggcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtggtggggggctttgaccgagtactgctggatgctccctgcagtggcactggggtcatctccaaggatccagccgtgaagactaacaaggatgagaaggacatcctgcgctgtgctcacctccagaaggagttgctcctgagtgctattgactctgtcaatgcgacctccaagacaggaggctacctggtttactgcacctgttctatcacagtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctgaaaaaaaaaa

SEQ ID NO: 58 - protein, 812 aa, Homo sapiens
  misc_feature: Incyte ID No: 2797839CD1
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 59 - DNA, 907 bp, Homo sapiens
  misc_feature: Incyte ID No: 978690.6
tggacggacatcaagcctgtgaaaccaataaaggccaagccccagtacaagcccccagatgataagatggttcatgagaccagctacagtgctcagttcaaaggagaggccagcaagccaacaacagctgacaataaggtcattgatcgcagaagaatacgcagcctctacagcgaacccttcaaggaacccccaaaggtggaaaaacctagtgttcagagttccaaaccaaaaaagacctcagcgagccataagcccacgaggaaggccaaagacaagcaggcggtgtcaggccaggctgccaagaaaaagagcgcggagggcccgagtaccaccaagccagacgacaaggagcaaagcaaagagatgaacaataaactggctgaggcgaaagagtaaatttccctgcactttccttttactcttctctctctctccctccccccaacttttttgttttagagcaacaaatcataaaaggccacagggttaattagaggcttctcatctgccttggtcctgagtgttccaggagctctttggtttggcttcttttgatggaagaatcctgcttcacagactgagtggcaggcctcctcctgagggcagcccctggagcaccaggaagcgttgccgctggctgtgccctcccctggcactctgactgcatgctgatgagcaaggcaggcaggtctgagaggcgaaacgaatctcccggcagtgcttggaagtgtctgtggggtctcctcctcccagatccccaagatctgtgtcactggtcgattttgaactttaggtacatgtgttcttttcaaaaattcagagaatcgtcatgtgccacagaagctcagcctgggcttcagcaattgacaaaatttgaagaaatattaaacaaaaataacaaaaa

SEQ ID NO: 60 - DNA, 2868 bp, Homo sapiens
  misc_feature: Incyte ID No: 348072.5
  unsure 2851: a, t, c, g, or other
tattcagcgatggactttgcatggtggccctgtctcatcttggctctgcctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagattccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgcaagaggaagactatctgaatttcatcctgttcagtggagatgtgtccacatggaaagagcacttagtccaggccatgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgttcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagacagctgccagcctctacatgccttcatgagcctctgctccagggaacangcaactgggacccacag

SEQ ID NO: 61 - DNA, 1952 bp, Homo sapiens
  misc_feature: Incyte ID No: 085596CB1
aaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagagtggaaaatacaactgtatattacttagtcttagatgtgcaagaatcggactgttcggtcctatccaggaaatactggaatgactgtgagccacctgattccagacgtccatctgaaatagtgatcggacaatgtaaggtaatagctacaagacattcccatgaatctcaggacctcagagtgattgactttaactgcaccacaagttctgtctcttcagcactggccaataccaaagatagtccggtcctcatagatttctttgaggatactgagcgctacagaaaacaagccaacaaagcccttgagaagtacaaagaggagaatgatgactttgcctctttcagagtggaccgaaccgagagagttgcaagagtgagaggaggggaaggaactggttacttcgtggacttctctgtgcggaactgccccagacaccatttccccagacaccccaatgtctttggattctgcagagcagatttgttctatgatgtagaagccttggacttggaaagcccgaaaaaccttgtcataaactgtgaagtcttcgaccctcaggaacatgagaacatcaatggtgtaccgcctcatttgggacatcccttccactggggtgggcatgagcgttcttctaccaccaagcctccattcaagccccatggatctagagatcatcatcatccccacaagccacacgaacatggacccccacctcctccagatgaaagagatcactcacatggacccccacttccacaaggccctcctccactattgcccatgtcctgctcaagttgtcaacatgccacttttggcacaaatggggcccaaagacgttctcataataataattccagtgacctccatccccataagcatcattcccatgaacagcatccccacggacaccatccccatgcacaccatcctcatgaacatgatacccatagacagcatccccatggacaccacccccatggacaccatcctcatggacaccacccccatggacaccatccccatggacaccatccccactgccatgatttccaagactatggaccttgtgacccaccaccccataaccaaggtcactgttgccatggccacggcccaccacctgggcacttaagaaggcgaggcccaggtaaaggaccctgtcccttccattgcagacaaattggatctgtgtaccgactccctcctctaagaaaaggtgaggtgctgccacttcctgaggccaattttcccagcttcccattgccgcaccacaaacatcctctaaagccagacattcagccctttcctcaatcagtctctgaatcatgtccagggaagttcaagagtgggtttccacaagtttccatgttttttacacatacatttccaaaataaaatgtgattcctttgaagaggaaaatgaataatacattgaattagaaacataaataaaatgaccagtaattgtgaaaattacagttcttttcaacctactttcatactgaagatgcagcaaaatgtgaatgggaaaagagatggcctgagaagagagatcaaatggaaaggagaggaaagaactcagtgctgcctattagtagttaattctgtcactcaccactacatcacttgagacaaatctatgccactcagaatctccttctttcctggacttaactctaattctagagtctctgttactgcttgggctatacctgggcatactaataaagtatggtattgaaactattgttaaaaaaaaaaaaaaa

SEQ ID NO: 62 - protein, 525 aa, Homo sapiens
  misc_feature: Incyte ID No: 085596CD1
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRTERVARVRGGEGTGYFVDFSVRNCPRHHFPRHPNVFGFCRADLFYDVEALDLESPKNLVINCEVFDPQEHENINGVPPHLGHPFHWGGHERSSTTKPPFKPHGSRDHHHPHKPHEHGPPPPPDERDHSHGPPLPQGPPPLLPMSCSSCQHATFGTNGAQRRSHNNNSSDLHPHKHHSHEQHPHGHHPHAHHPHEHDTHRQHPHGHHPHGHHPHGHHPHGHHPHGHHPHCHDFQDYGPCDPPPHNQGHCCHGHGPPPGHLRRRGPGKGPCPFHCRQIGSVYRLPPLRKGEVLPLPEANFPSFPLPHHKHPLKPDIQPFPQSVSESCPGKFKSGFPQVSMFFTHTFPK

SEQ ID NO: 63 - DNA, 1635 bp, Homo sapiens
  misc_feature: Incyte ID No: 103917CB1
gcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactct

SEQ ID NO: 64 - protein, 217 aa, Homo sapiens
  misc_feature: Incyte ID No: 103917CD1
MAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 65 - DNA, 2977 bp, Homo sapiens
  misc_feature: Incyte ID No: 3603037CB1
gagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcaagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaataaaaaaaaaa

SEQ ID NO: 66 - protein, 456 aa, Homo sapiens
  misc_feature: Incyte ID No: 3603037CD1
MMTAKAVDKIPVTLSGFVHQLSDNIYPVEDLAATSVTIFPNAELGGPFDQMNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGVTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQAWGYPVQQ

SEQ ID NO: 67 - DNA, 824 bp, Homo sapiens
  misc_feature: Incyte ID No: 088564CB1
gcactcccaaagaactgggtactcaacactgagcagatctgttctttgagctaaaaaccatgtgctgtaccaagagtttgctcctggctgctttgatgtcagtgctgctactccacctctgcggcgaatcagaagcagcaagcaactttgactgctgtcttggatacacagaccgtattcttcatcctaaatttattgtgggcttcacacggcagctggccaatgaaggctgtgacatcaatgctatcatctttcacacaaagaaaaagttgtctgtgtgcgcaaatccaaaacagacttgggtgaaatatattgtgcgtctcctcagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaaactatttaacattcttttgtttatattgttttgtctcctaaattgttgtaattgcattataaaataagaaaaatattaataagacaaatattgaaaataaagaaacaaaaagtt

SEQ ID NO: 68 - protein, 96 aa, Homo sapiens
  misc_feature: Incyte ID No: 088564CD1
MCCTKSLLLAALMSVLLLHLCGESEAASNFDCCLGYTDRILHPKFIVGFTRQLANEGCDINAIIFHTKKKLSVCANPKQTWVKYIVRLLSKKVKNM

SEQ ID NO: 69 - DNA, 1087 bp, Homo sapiens
  misc_feature: Incyte ID No: 040429.1
ctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaatatcttacatacctccaccagactggacttgctttttgaattttaagcaagtttcctttccttttatacaaattgcaaatttcatatttttttaatcacatcctaggaatagcacaataattgggaaatagaacccttatcactagaagaaccattttctgccactaaatatctctgatgtttccatgagtctgagggcagagactctggtatatgaaaacatgtctgaaagtcacatattgtgaaaatttgaagctatctcagtaaaaagcagctttggaaactgtgaatgatctttagcttgtacaaatgtttaaaaatacctcaggctatactgaaagggttgcagtttggttaggagtggaaatattttgtttgttaatgatgtcttcagttctggtacctctgttttactttcttatgctctttggaaactttttgcaaaatttaagcctgggttctagataataccagatctacctaaacctcaagtctatgttaaagttgatttcctgctgttaaataagctatgatattaagatattctgacttgctccagtgtcaagggaccttctgggagcaggtgctaacatagtgttcagaatcaatatgtgagatgaaaaggatcccctccaggaggatcctgagctgttcagaaatcatttaagtttacagcgttgttccctttgcgtttgcagtgcgttttactcaagtagccagaaacaccccacgtttctgaatttgtttaaactgtaacaataaagtaaaatagaatgcatgaaagat

SEQ ID NO: 70 - DNA, 5144 bp, Homo sapiens
  misc_feature: Incyte ID No: 407096.2
  unsure 4537, 4540, 4590, 5133: a, t, c, g, or other
tctgactctggcagttagcccgcccgctcggcgcagggcgtggcttctcgtagccattaggaaacagcaaccctttcacctcagttttcttcactccggcatttgcagcagagcgaaaggtggtggagtcctgaaggagggcctgatgtcttcatcattctcaaattcttgtaagctctgcgtcgggtgaaaccagacaaagccgcgagcccagggatgggagcacgcgggggacggcctgccggcggggacgacagcattgcgcctgggtgcagcagtgtgcgtctcggggaagggaagatattttaaggcgtgtctgagcagacggggaggcttttccaaacccaggcagcttcgtggcgtgtgcggtttcgacccggtcacacaaagcttcagcatgtcatgtgaggacggtcgggccctggaaggaacgctctcggaattggccgcggaaaccgatctgcccgttgtgtttgtgaaacagagaaagataggcggccatggtccaaccttgaaggcttatcaggagggcagacttcaaaagctactaaaaatgaacggccctgaagatcttcccaagtcctatgactatgaccttatcatcattggaggtggctcaggaggtctggcagctgctaaggaggcagcccaatatggcaagaaggtgatggtcctggactttgtcactcccacccctcttggaactagatggggtctcggaggaacatgtgtgaatgtgggttgcatacctaaaaaactgatgcatcaagcagctttgttaggacaagccctgcaagactctcgaaattatggatggaaagtcgaggagacagttaagcatgattgggacagaatgatagaagctgtacagaatcacattggctctttgaattggggctaccgagtagctctgcgggagaaaaaagtcgtctatgagaatgcttatgggcaatttattggtcctcacaggattaaggcaacaaataataaaggcaaagaaaaaatttattcagcagagagatttctcattgccactggtgaaagaccacgttacttggggcatccctggtgacaaagaatactgcatcagcagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagttgaacaaattgaagcagggacaccaggccgactcagagtagtagctcagtccaccaatagtgaggaaatcattgaaggagaatataatacggtgatgctggcaataggaagagatgcttgcacaagaaaaattggcttagaaaccgtaggggtgaagataaatgaaaagactggaaaaatacctgtcacagatgaagaacagaccaatgtgccttacatctatgccattggcgatatattggaggataaggtggagctcaccccagttgcaatccaggcaggaagattgctgggctcagaggctctatgcaggttccactgtcaagtgtgactatgaaaatgttccaaccactgtatttactcctttggaatatggtgcttgtggcctttctgaggagaaagctgtggagaagtttggggaagaaaatattgaggtttaccatagttacttttggccattggaatggacgattccgtcaagagataacaacaaatgttatgcaaaaataatctgtaatactaaagacaatgaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaatttatacacaatacaaacgtgcggggacaccgtccccttcacagcccagaacccagggtcagaagatgagggatccagcctcagaggggagatatgcgacttcccaagagcagttcttggcctggaggggccatgagagtgcaagacacggggccgtggccggggcggggctacgggagcggggcgtggccggcccctgaggttactataggggaatgggccccggccaggtcccctctccttggggcagtgggaagacagcggggcccacgggccagagctgctacacgtaggcgtttctgccgtatttgccaaagctgctgtcgccttcttggtccgaggtggcgacgggcatcacggacacgggagcctggtagggccgccgggcgctggcggctgggtcctcgtcagagccgcagcagcaggcggagcagaggcagaggccacccaggatggagatcagtgaggcgctccaccccaggtagagggcggggcccagctcgtacttggttccggggtacaaggggtcgaagaagtcccgggtgatgttgaaggcgtaccaggagatggccaccatcccgcagatacctggggaccggaggacgaccccagtccagtccagggggagggatagtggnggngggggcttaggggagaggcaggcaggggctgcccagagtaggacgggggnaccaagtcccagagcagcaatttcactcaattcctttctccccaccccagtttataagccttcctccttcctggggtcaacttctcagggtagcccttaggccccaagtccagcccacccagctcatctcacactacctcaacctcctcctgcctcttctctctttggtcccagatctacctagttcatgcccacctctagggccttcatcccatcatctcctcacccagatggagccccatccaaatcccgcccacccttgaaaccttgaaaacccagctgggccatgggagtccagggtcgtcctttcctgaagccaggcagacccccgggctagcaccaccctactcactgggggcttgtcctcttgcaagccacctgacctttctgggcctgttttacctctggaaaacaagcaatacccaccctacctcaaaggcttattgtgaggcaatgggtacagaaatgttctgcaaattgaaaagcaatggccagatggcattgtttttgttttttgctgagacgggttctcactatgctgcnccaggctagtc

SEQ ID NO: 71 - DNA, 2752 bp, Homo sapiens
  misc_feature: Incyte ID No: 209265.54
ctttcctgggttgcaggagattactgcttgcggggaagaccaagacgccaggccggcggattagtccccgccccggggcggtgcagctggagcgtcaggggagtcccgctcgccgcagccccagcgccgcgcgcgcccctccctcctcgcggacctggcggtgccggcgcccggagtggccctttaaaaggcagcttattgtccggagggggcgggcggggggcgccgaccgcggcctgaggcccggcccctcccctctccctccctctgtccccgcgtcgctcgctggctagctcgctggctcgctcgccccgtccggcgcacgctccgcctccgtcagttggctccgctgtcgggtgcgcggcgtggagcggcagccggtctggacgcgcggccggggctgggggctgggagcgcggcgcgcaagatctccccgcgcgagagcggcccctgccaccgggcgaggcctgcgccgcgatggcagagatgggcagtaaaggggtgacggcgggaaagatcgccagcaacgtgcagaagaagctcacccgcgcgcaggagaaggttctccagaagctggggaaggcagatgagaccaaggatgagcagtttgagcagtgcgtccagaatttcaacaagcagctgacggagggcacccggctgcagaaggatctccggacctacctggcctccgtcaaagccatgcacgaggcttccaagaagctgaatgagtgtctgcaggaggtgtatgagcccgattggcccggcagggatgaggcaaacaagatcgcagagaacaacgacctgctgtggatggattaccaccagaagctggtggaccaggcgctgctgaccatggacacgtacctgggccagttccccgacatcaagtcacgcattgccaagcgggggcgcaagctggtggactacgacagtgcccggcaccactacgagtcccttcaaactgccaaaaagaaggatgaagccaaaattgccaagcctgtctcgctgcttgagaaagccgccccccagtggtgccaaggcaaactgcaggctcatctcgtagctcaaactaacctgctccgaaatcaggccgaggaggagctcatcaaagcccagaaggtgtttgaggagatgaatgtggatctgcaggaggagctgccgtccctgtggaacagccgcgtaggtttctacgtcaacacgttccagagcatcgcgggcctggaggaaaacttccacaaggagatgagcaagctcaaccagaacctcaatgatgtgctggtcggcctggagaagcaacacgggagcaacaccttcacggtcaaggcccagcccagtgacaacgcgcctgcaaaagggaacaagagcccttcgcctccagatggctcccctgccgccacccccgagatcagagtcaaccacgagccagagccggccggcggggccacgcccggggccaccctccccaagtccccatctcagctccggaaaggcccaccagtccctccgcctcccaaacacaccccgtccaaggaagtcaagcaggagcagatcctcagcctgtttgaggacacgtttgtccctgagatcagcgtgaccaccccctcccagtttgaggccccggggcctttctcggagcaggccagtctgctggacctggactttgaccccctcccgcccgtgacgagccctgtgaaggcacccacgccctctggtcagtcaattccatgggacctctgggagcccacagagagtccagccggcagcctgccttccggggagcccagcgctgccgagggcacctttgctgtgtcctggcccagccagacggccgagccggggcctgcccaaccagcagaggcctcggaggtggcgggtgggacccaacctgcggctggagcccaggagccaggggagacggcggcaagtgaagcagcctccagctctcttcctgctgtcgtggtggagaccttcccagcaactgtgaatggcaccgtggagggcggcagtggggccgggcgcttggacctgcccccaggtttcatgttcaaggtacaggcccagcacgactacacggccactgacacagacgagctgcagctcaaggctggtgatgtggtgctggtgatccccttccagaaccctgaagagcaggatgaaggctggctcatgggcgtgaaggagagcgactggaaccagcacaaggagctggagaagtgccgtggcgtcttccccgagaacttcactgagagggtcccatgacggcggggcccaggcagcctccgggcgtgtgaagaacacctcctcccgaaaaatgtgtggttcttttttttgttttgttttcgtttttcatcttttgaagagcaaagggaaatcaagaggagacccccaggcagaggggcgttctcccaaagattaggtcgttttccaaagagccgcgtcccggcaagtccggcggaattcaccagtgttcctgaagctgctgtgtcctctagttgagtttctggcgcccctgcctgtgcccgcatgtgtgcctggccgcagggcggggctgggggctgccgagccaccatgcttgcctgaagcttcggccgcgccacccgggcaagggtcctcttttcctggcagctgctgtgggtggggcccagacaccagcctagcctggctctgccccgcagacggtctgtgtgctgtttgaaaataaatcttagtgttcaaaacaaaatgaaacaaaaaaaaaatgataaaaactctc

SEQ ID NO: 72 - DNA, 2496 bp, Homo sapiens
  misc_feature: Incyte ID No: 701484CB1
agctatgactgcgcctctgcactccaacctgggtgacagaggaagaccctgtctcaaaaaaataaataacattgaaaaggaactctcccaaaagtatcttattctttctccataggcctcagagaaccatggctactgccaagggaatcgccataggaatcgacctgggcaccacctactcctgtgtgggggtgttccagcacggcaaggtggagatcatcgccaacgaccagggcaaccgcaccacccccagctacgtggccttcacagacaccgagcggctcattggggatgcggccaagaaccaggtagcaatgaatccccagaacactgtttttgatgctaaacgtctgatcggcaggaaatttaatgatcctgttgtacaagcagatatgaaactttggccttttcaagtgattaatgaaggaggcaagcccaaagtccttgtgtcctacaaaggggagaataaagctttctaccctgaggaaatctcttcgatggtattgactaagttgaaggagactgctgaggcctttttgggccaccctgtcaccaatgcagtgattaccgtgccagcctatttcaatgactctcaacgtcaggctactaaggatgcaggtgtgattgctggacttaatgtgctaagaatcatcaatgagcccacggctgctgccattgcctatggtttagataaaggaggtcaaggagaacgacatgtcctgatttttgatctgggtggaggcacatttgatgtgtcaattctgaccatagatgatgggatttttgaggtaaaggccactgctggggacactcacctgggtggggaggactttgacaacaggcttgtgagccacttcgtggaggagttcaagaggaaacacaaaaaggacatcagccagaacaagcgagccgtgaggcggctgcgcaccgcctgcgagagggccaagaggaccctgtcgtccagcacccaggccaacctagaaattgattcactttatgaaggcattgacttctatacatccatcaccagagctcgatttgaagagttgtgtgcagacctgtttaggggtaccctggagcctgtagaaaaagcgcttcgggatgccaagatggataaggctaaaatccatgacattgttttagtagggggctccacccgcatccccaaggtgcagcggctgcttcaggactacttcaatggacgtgatctcaacaagagcatcaaccctgatgaggccgtagcatatggggctgcggtacaagcagccatcctgatgggggacaagtctgagaaggtacaggacctgctgctgctggacgtggctcccctgtccctgggtctggagacggttgggggcgtgatgactgccctgataaagcgcaactccaccatcccacccaagcagacacagattttcaccacctactctgacaaccaacccggggtgctgatccaggtgtatgagggcgagagggccatgacaaaggacaacaacctgctggggcggtttgatctgactggaatccctccagcacccaggggagttcctcagatcgaggtgacgtttgacattgatgccaatggtattctcaatgtcacagccatggacaagagcaccggcaaggtgaacaagatcaccatcaccaatgacaagggccgcctgagcaaggaggagattgagcgcatggttctggatgctgagaaatataaagctgaagatgaggtccagagggagaaaattgctgcaaagaatgccttagaatcctatgcttttaacatgaagagtgttgtgagtgatgaaggtttgaagggcaagattagtgagtctgataaaaataaaatattggataaatgcaacgagctcctttcgtggctggaggtcaatcaactggcagagaaagatgagtttgatcataagagaaaggaattggagcagatgtgtaaccctatcatcacaaaactctaccaaggaggatgcactgggcctgcctgcggaacagggtatgtgcctggaaggcctgccacaggccccacaattgaagaagtagattaattctttttagaactgaagcatcctaggatgcctctacatgtatttcattcccctcatcttcaaacatcattattattcttgaccagacctgaatctaagttaccatcccttggaaattctggagaaggagtctcatgcaccacctatcacactccctcacatcctgtttctgactttggaatggactcaggaaaactaggcccctctttaaaccgtgtgatgtatttgaatgtctgttatttccagccaccctaacattcttcttcctgtgtggatgcttatttgtcaatcagtaaatttgttcgtaaagaaaattacttctggtatttaggctgtgaatgtaccttgaaggggagagttcatggagagagcatgtgttctctgattgtgaggtcactgtgaatgattaaattggtaagggtaaagtatttgaaaaaaaaaa

SEQ ID NO: 73 - protein, 641 aa, Homo sapiens
  misc_feature: Incyte ID No: 701484CD1
MATAKGIAIGIDLGTTYSCVGVFQHGKVEIIANDQGNRTTPSYVAFTDTERLIGDAAKNQVAMNPQNTVFDAKRLIGRKFNDPVVQADMKLWPFQVINEGGKPKVLVSYKGENKAFYPEEISSMVLTKLKETAEAFLGHPVTNAVITVPAYFNDSQRQATKDAGVIAGLNVLRIINEPTAAAIAYGLDKGGQGERHVLIFDLGGGTFDVSILTIDDGIFEVKATAGDTHLGGEDFDNRLVSHFVEEFKRKHKKDISQNKRAVRRLRTACERAKRTLSSSTQANLEIDSLYEGIDFYTSITRARFEELCADLFRGTLEPVEKALRDAKMDKAKIHDIVLVGGSTRIPKVQRLLQDYFNGRDLNKSINPDEAVAYGAAVQAAILMGDKSEKVQDLLLLDVAPLSLGLETVGGVMTALIKRNSTIPPKQTQIFTTYSDNQPGVLIQVYEGERAMTKDNNLLGRFDLTGIPPAPRGVPQIEVTFDIDANGILNVTAMDKSTGKVNKITITNDKGRLSKEEIERMVLDAEKYKAEDEVQREKIAAKNALESYAFNMKSVVSDEGLKGKISESDKNKILDKCNELLSWLEVNQLAEKDEFDHKRKELEQMCNPIITKLYQGGCTGPACGTGYVPGRPATGPTIEEVD

SEQ ID NO: 74 - DNA, 3954 bp, Homo sapiens
  misc_feature: Incyte ID No: 251859.2
  unsure 3786, 3788, 3791: a, t, c, g, or other
ggacagccccggggccctatggaaggcgggtcctgcggccggctggggcgggacggcgccgggcgctgccccggggattcgggccggctcgcgggcgctgccagtctcgggcggcggtgtccggcgcgcgggcggcctgctgggcgggctgaagggttagcggagcacgggcaaggcggagagtgacggagtcggcgagcccccgcggcgacaggttctctacttaaaagacaatgactactgatgaaggtgccaagaacaatgaagaaagccccacagccactgttgctgagcagggagaggatattacctccaaaaaagacaggggagtattaaagattgtcaaaagagtggggaatggtgaggaaacgccgatgattggagacaaagtttatgtccattacaaaggaaaattgtcaaatggaaagaagtttgattccagtcatgatagaaatgaaccatttgtctttagtcttggcaaaggccaagtcatcaaggcatgggacattggggtggctaccatgaagaaaggagagatatgccatttactgtgcaaaccagaatatgcatatggctcggctggcagtctccctaaaattccctcgaatgcaactctcttttttgagattgagctccttgatttcaaaggagaggatttatttgaagatggaggcattatccggagaaccaaacggaaaggagagggatattcaaatccaaacgaaggagcaacagtagaaatccacctggaaggccgctgtggtggaaggatgtttgactgcagagatgtggcattcactgtgggcgaaggagaagaccacgacattccaattggaattgacaaagctctggagaaaatgcagcgggaagaacaatgtattttatatcttggaccaagatatggttttggagaggcagggaagcctaaatttggcattgaacctaatgctgagcttatatatgaagttacacttaagagcttcgaaaaggccaaagaatcctgggagatggataccaaagaaaaattggagcaggctgccattgtcaaagagaagggaaccgtatacttcaagggaggcaaatacatgcaggcggtgattcagtatgggaagatagtgtcctggttagagatggaatatggtttatcagaaaaggaatcgaaagcttctgaatcatttctccttgctgcctttctgaacctggccatgtgctacctgaagcttagagaatacaccaaagctgttgaatgctgtgacaaggcccttggactggacagtgccaatgagaaaggcttgtataggaggggtgaagcccagctgctcatgaacgagtttgagtcagccaagggtgactttgagaaagtgctggaagtaaacccccagaataaggctgcaagactgcagatctccatgtgccagaaaaaggccaaggagcacaacgagcgggaccgcaggatatacgccaacatgttcaagaagtttgcagagcaggatgccaaggaagaggccaataaagcaatgggcaagaagacttcagaaggggtcactaatgaaaaaggaacagacagtcaagcaatggaagaagagaaacctgagggccacgtatgacgccacgccaaggagggaagagtcccagtgaactcggcccctcctcaatgggctttcccccaactcaggacagaacagtgtttaatgtaaagtttgttatagtctatgtgattctggaagcaaatggcaaaaccagtagcttcccaaaaacagcccccctgctgctgcccggagggttcactgaggggtggcacgggaccactccaggtggaacaaacagaaatgactgtggtgtggagggagtgagccagcagcttaagtccagctcatttcagtttctatcaaccttcaagtatccaattcagggtccctggagatcatcctaacaatgtggggctgttaggttttacctttgaactttcatagcactgcagaaacctttaaaaaaaaaaatgcttcatgaatttctcctttcctacagttgggtagggtaggggaaggaggataagcttttgttttttaaatgactgaagtgctataaatgtagtctgttgcatttttaaccaacagaacccacagtagaggggtctcatgtctccccagttccacagcagtgtcacagacgtgaaagccagaacctcagaggccacttgcttgctgacttagcctcctcccaaagtccccctcctcagccagcctccttgtgagagtggctttctaccacacacagcctgtccctgggggagtaattctgtcattcctaaaacacccttcagcaatgataatgagcagatgagagtttctggattagcttttcctattttcgatgaagttctgagatactgaaatgtgaaaagagcaatcagaattgtgctttttctcccctcctctattccttttagggaataatattcaatacacagtacttcctcccagcattgctactgctcagcttcttctttcattctaatccttgctattaagaatttaagacttgtgcttacaatatttttgacctggagtggatctatttacatagtcatttaggatccatgcagctttttttgtctttttaagattattggctcataagcatatgtatactggtttatggaactttatttacactcctctatcatgcaaaaaaattttgactttttagtactaagcttaatttttaaaaacaaaatctgtagtgttgacaaataaatagttgctcttctacactaggggtttcacctgcaggtttgacacgcagttgctcgcttttcctgccctgtcaagcttctctgttctggcgtgagttgtgaaagagttgaagacagcttcccatgccggtacacagccagtagcctaaatctccagtacttgagctgaccattgaactagggcaagtcttaaatgtgtacatgtagttgaatttcagtccttacgggtaaacagattgagcatggctctctattccctcagcctaagaaacactcatgggaatgcatttggcaacccaaggaaccatttgcttaaacctggaacatctcacctttttaaatcctaaaaaacactggcagttatattttaaattagtttttatttttatgatggttttatcaaaagacttttattattagattgggacccccttcaaacctaaaaatcaagttatttccttttataatacttttcttccccatggaacaaatgggatcaatttgtgagttttttcctttaatgataactaaaatccctctaatttctcatttatgcttttgtcttttttatgaaatatttcttttaaaagccccagtctcacctacgaaatatgaagagcaaaagctgattttgcttacttgctaaactgttgggaaagctctgtagagcatggttccagtgaggccaagattgaaatttgatactaaaaaggccacctagctttttgcagataacaaacaagaaagctattccaagactcagatgatgccagctgtctcccacgtgtgtattatggttcaccagggggaactggcaaaagtgtgtgtggggaggggaagggtgtgtgagtggttctgagcaaataactacagggtgcccattaccactcaagaagacacttcacgtattcttgtatcaaattcaataatcttaaacaatttgtgtagaagtccacagacatctttcaaccaccttttaggctgcatatggattgccaagtcagcatatgaggaattaaagacattgtttntnaanaaaaaaaatcatttagatgcacttttttgtgtgttctttaaataaatccaaaaaaaatgtgacttcccattgtttttggttttgcttaagtgattttcagggaaagctatattggttaaaaaaccatggtgggggccaacttgaagaaattagacatcagaga

SEQ ID NO: 75 - DNA, 3586 bp, Homo sapiens
  misc_feature: Incyte ID No: 3766715CB1
tacacttttggaaacagtgggagtaggagaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataagacccact

SEQ ID NO: 76 - protein, 920 aa, Homo sapiens
  misc_feature: Incyte ID No: 3766715CD1
MLQGHFWLVREGIMISPSSPPPPNLFFFPLQIFPFPFTSFPSHLLSLTPPKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 77 - DNA, 3428 bp, Homo sapiens
  misc_feature: Incyte ID No: 2049950CB1
ggcacgaggctgagtgtccgtctcgcgcccggaagcgggcgaccgccgtcagcccggaggaggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtggaatacatgttggtatcttttgatcatgaaaataaaaaagtccggttggtcctgtctggggagaaagttcttgaaactctgcaagagaagggggaaaggacaaacccaaaccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccagattaggctgtcctgggttcacactgcccgaggtcaaacccaacccagtggaaggaggagcttccaagtccctcttctttccagatgaagcaataaacaagcaccctcgcttcagtaccttaacaagaaatatccgacataggagaggagaaaaggttgtcatcaatgtaccaatatttaaggacaagaatacaccatctccatttatagaaacatttactgaggatgatgaagcttcaagggcttctaagccggatcatatttacatggatgccatgggatttggaatgggcaattgctgtctccaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggttgatgagaacatgaaggtagcacagaaaagagatgctgtcttgcagggaatgttttatttcaggaaagatatttgcaaaggtggcaatgcagtggtggatggttgtggcaaggcccagaacagcacggagctcgctgcagaggagtacaccctcatgagcatagacaccatcatcaatgggaaggaaggtgtgtttcctggactgatcccaattctgaactcttaccttgaaaacatggaagtggatgtggacaccagatgtagtattctgaactacctaaagctaattaagaagagagcatctggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaattttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaaaaaaaaaaaaaa

SEQ ID NO: 78 - protein, 637 aa, Homo sapiens
  misc_feature: Incyte ID No: 2049950CD1
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 79 - DNA, 1093 bp, Homo sapiens
  misc_feature: Incyte ID No: 231588.6c
gcatccctcactgactgaagggataggaaggcaacaagccagtagaagagaaaatgctttgctaaacatcatcgtatgtctgtgtcttatttctcttttttgactatttaatcttatttcacttaggaccttggttatttatattagttgtctataggcagtggaacataattaaataccattttctagttaaattcacctaagacaacttttaaacaaaactcttgcgttaaatgttgccattaatgaagcgttgttaacttgcccctctctgcccagcaccttccttctctgacttcactgcttggggagcatgctaatgattccttggtgttaataactttgcaattcttaaacaggtgacattccaagcctgcagtatatctgaggccagatacctttatgatcagttggctactatctgtccaattgttatggctttgagtgctgcatctcccttttaccgaggctatgtgtcagacattgattgtcgctggggagtgatttctgcatctgtagatgatagaactcgggaggagcgaggactggagccattgaagaacaataactataggatcagtaaatcccgatatgactcaatagacagctatttatctaagtgtggtgagaaatataatgacatcgacttgacgatagataaagagatctacgaacagctgttgcaggaaggcattgatcatctcctggcccagcatgttgctcatctctttattagagacccactgacactgtttgaagagaaaatacacctggatgatgctaatgagtctgaccattttgagaatattcagtccacaaattggcagacaatgagatttaagccccctcctccaaactcagacattggatggagagtagaatttcgacccatggaggtgcaattaacagactttgagaactctgcctatgtggtgtttgtggtactgctcaccagagtgatcctttcctacaaattggattttctcattccactgtcaaaggtaaggatatgtttctttatggtgatgggtatagatctatctgtagatatatttatttatatatgctatttatttcccacctgatttcattt

SEQ ID NO: 80 - DNA, 834 bp, Homo sapiens
  misc_feature: Incyte ID No: 152298.2
  unsure 343-385: a, t, c, g, or other
ggcattttgctatggcagcccaaatagactgagacatactccttaacctttgacccacttctgtttaggcccagccagccttcctgagcctgtgcatagtcttcctggctcaaggaactctctctaccgaggtgtgatctcctaactcctggcactcatttacctatccatggttggtagtcagcctccaagatgcctgcagtcatccctgcctcctgggattcatatcctcctccacattgtgccaggattgggctctgtggccaaaaagaaaacagcagatgagaggacgtgtctcttctcagaagggttagaaaagactgtggcttccattttagatgannnnnnnnnnnnnnnnnnnnnnnnnnnnnnnnnnnnnnnnnnnctcttttccttcttctcttccttggatctcttgctctgaggaaagcaaactactatgttgtgagcagcccaatggagaggcccacaagacaacgaactgaagcctccagcaacaaccctgtgaggtcagtttggaagtggattttctagccccaattgagcttaagatgacttcagcttcagcagacagcttgactgcagcctttctagagagcaagcaccacccagctctgctgcttctagacccctgacctcagaaattgcacgagataacatgtttgctgtttcaggctgccaaatttaggggctggaactgcccataaaggctggcaccccagcagccaccttgagaaatgcagtgatgatgctgagtggcaaggcagaaggcacagggtccctgcacctgaggattgctgctccaaacctgggccaccagcctgaagatcccgc

SEQ ID NO: 81 - DNA, 351 bp, Homo sapiens
  misc_feature: Incyte ID No: 199507.1
agctcatggagttaggaacaagtatgttaaatatttatcagagtgtgcctgacagtgagttgaaaatatctactctctttggatgaaaaatatttaacacttcactctcagatataattattagctgactttttagattcttttttcttttacatgatgtagttctcagatatatacgggatttctagttcttaaatgccagtattttttttctgttaaaatatttatgaactatttcaaacattcagaaaaactcaggatcatacccataaacccactgtttagattttaaaaagttcaatgtttttctgtattttatctcttccattttaaaataaagttttgcacatg

SEQ ID NO: 82 - DNA, 919 bp, Homo sapiens
  misc_feature: Incyte ID No: 1434821CB1
  unsure 15, 19, 40, 48, 55-56, 85-86, 88-299, 859, 861, 863, 866, 872, 874-875,877, 879-881, 890, 906-907: a, t, c, g, or other
acggcctaggcctgnaatntacggtcatggcgtaccacanaccgccgncttaatnnccgctaaggcgcgtcccatcgccattcanntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctctttaagcaaacagagcctgccctataaaatccggggctcgggcggcctctcatccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaanananaanggaaangnnancnnngaaagaganaaaaaaaagggcggcnncgactaatgaat

SEQ ID NO: 83 - protein, 84 aa, Homo sapiens
  misc_feature: Incyte ID No: 1434821CD1
MATMENKVICALVLVSMLALGTLAEAQTETCTVAPRERQNCGFPGVTPSQCANKGCCFDDTVRGVPWCFYPNTIDVPPEEECEF

SEQ ID NO: 84 - DNA, 2734 bp, Homo sapiens
  misc_feature: Incyte ID No: 289671.27
gaaaggcttttactgggcagacggggtgagtctcaagccagtggaccagtgaggggtgagggcacgtcctccgaaggagcaggtttttcctttgggtttaggtgtaagtgaactattatcattggagtggagaactggagagaaagggttgtcactgtccagcactacacagctgcaggcacacagatggtacacattcccagaaagacacataggtagacacgtggctgtacacccatgcacacacaaacaatcacgcatacctgtaggcatgtgtgtaaacacccacatgcacccacacccacatgcctggcagtacacagaactgtatgcatccatttgtgccaggctggggccttgagtgataggaaaggggtctgtgatgggtagatagtgtggttggagacacggatttcttcctgaacaaagtccctcccctacatggtggacatgggatgagacggccttcagttacttcctcttgacccccagggctgcctgccgcctcatgtaggacaggatgtccatcttgacgttgctgaccgtggtccggtggtgccagcgcatgatgggtataccatctggccccaccaggaacttctcaaattccagcggatgtcgtgaaccttcatgggttcccagaagaggcggtcagatgtacccaggagctccgaggtgggaggacaggagttctttaggaaagtgtagaatttctgctctttctctccattgacatcccctttctcaaagagctggaaattagggacaaagcctccacctggtcggacatacttgagggtaggaaggatctctgagttctctcctggttcctgttttccaaattggttgcagggaaagccccagaatgaccagaccgaatggtgcaagctcttcctgtagtgcattcagttcaatgtactggcccgtcaggcctcagtagctggccacgttgacaaagaggacgtatttgccagcatactgcttgaaggggatgtactcctccccatcaatggtgagggctccgtactcgtaaatggtgccacttatgccaccatggcagtccatcttcgacttctcttgtccccggctctgcgagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggctccccgccagatgggcaatccccagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctgagatcaaccaaggcagatgtgacagcaagggccacggaccccatggcaggggtggcgtcttcatgagggaggggcccaaagcccttgtgggcggacctcccctgagcctgtctgaggggccagcccttagtgcattcaggctaaggcccctgggcagggatgccacccctgctccttcggaggacgtgccctcacccctcactggtccactggcttgagactcaccccgtctgcccagtaaaagcctttctgcagcagctgaaaaaa

SEQ ID NO: 85 - DNA, 528 bp, Homo sapiens
  misc_feature: Incyte ID No: 1282225CB1
ggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaagacagtggttcagttggaaggtgacaataaactggtgacagctttcaaaaacatcaagtctgtgaccgaactcaacggcgacataatcaccaataccatgacattgggtgacattgtcttcaagagaatcagcaagagaatttaaacaagtctgcatttcatattattttagtgtgtaaaattaatgtaataaagtgaactttg

SEQ ID NO: 86 - protein, 127 aa, Homo sapiens
  misc_feature: Incyte ID No: 1282225CD1
MSFSGKYQLQSQENFEAFMKAIGLPEELIQKGKDIKGVSEIVQNGKHFKFTITAGSKVIQNEFTVGEECELETMTGEKVKTVVQLEGDNKLVTAFKNIKSVTELNGDIITNTMTLGDIVFKRISKRI

SEQ ID NO: 87 - DNA, 324 bp, Homo sapiens
  misc_feature: Incyte ID No: 263336.57
ctgcctgactgcttgttcgtctcactggtgtgagctccagcatcccctttgctcgaaatggaccccaactgctcttgcgccactggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaaaaaaaa

SEQ ID NO: 88 - DNA, 933 bp, Homo sapiens
  misc_feature: Incyte ID No: 464689.40
cacctggaatggaagcacgtgggaagcaatgtttattggcctaaaacatcaatgtatgtgagcatctcatctcctagtgagaaatgaggaaaaatacctctgggttaaatggcaggaatgagatgctctgtggactgaatgccaggaactggaagtttgccgaaatttcatcatcacatgagaaccttcctagaatagatccagtgtccctgccccctgggtcataggtagcggaattcagttaatccttggcattggcatagagaaacaagttactggggaggcctggggcatggcatccctgccagctggcaggaggaggtggcttgtgtgccttgcaggtgacaatgtgggcagctcatgaaggtaggcttgaagccccaggcaagcccagtgacccggtcacagtgaagtgcctgtgtgtgtaagaaactgacagaacgtgctgtccctgcctcctgctctttcacatgtgtagatcgtagctggggtgaactacttcttggacgtggagctgggccgaaccacgtgtaccaagacccagcccaacttggacaactgccccttccatgaccagccacatctgaaaaggaaagcattctgctctttccagatctacgctgtgccttggcagggcacaatgaccttgtcgaaatccacctgtcaggacgcctaggggtctgtaccgggctggcctgtgcctatcacctcttatgcacacctcccaccccctgtattcccacccctggactggtggcccctgccttggggaaggtctccccatgtgcctgcaccaggagacagacagagaaggcagcaggcggcctttgttgctcagcaaggggtctgccctccctccttccttcttgcttctcatagccccggtgtgcggtgatacacccccacctcctgcaataaaatagtagcatcggc

SEQ ID NO: 89 - DNA, 1788 bp, Homo sapiens
  misc_feature: Incyte ID No: 155943.1
  unsure 32, 361, 1085, 1180, 1183, 1191, 1207, 1234, 1247, 1275, 1319,1327-1328, 1332, 1336, 1338, 1343, 1345, 1351, 1353, 1362-1363, 1366, 1368,1376-1378, 1380, 1383-1384, 1388, 1396, 1398-1399, 1402, 1411-1413: a, t, c, g, or other
ctctgcttcaaatgcgctctttcaaaccattnattatcctgtgtatttttaatgtggttttagtaaatgttggtagtagctctgttgaagtaggtaattgtgttatgttttgggtggtacacacttggggcatggtaacccaaatttcatgtgcacggtttccctttagcccactgcccaaatttcacatacccttcaccctttgttccctttgtaaaaggagtggtatctgttttgagctgccaattcagatgatcagaaatgctgctttcctcagcattgtcttgttaaaccgcatgccatttggaactttggcagtgagaagccaaaaggaagaggtgaatgacatatatatatatanattcaatgaaagtaaaatgtatatgctcatatactttctagttatcagaatgagttaagctttatgccattgggctgctgcatattttaatcagaagataaaagaaaatctgggcatttttagaatgtgatacatgtttttttaaaactgttaaatattatttcgatatttgtctaagaaccggaatgttcttaaaatttactaaaacagtattgtttgaggaagagaaaactgtactgtttgccattattacagtcgtacaagtgcatgtcaagtcacccactctctcaggcatcagtatccacctcatagctttacacattttgatggggaatattgcagcatcctcaggcctgacatctgggaaaggctcagatccacctactgctccttgctcgttgattttgttttaaaatattgtgcctggtgtcaacttttaagcaacagcactgcctaaaagcaagcagagaacagaatcccagcaccattctataggcaactttttagaattcagatatagtaaatctgttccagatttatgatgttttatgtaaaaaaaattttgtataataacatagctgaatatttttgtttcttttctttgatgtaaggcgtgtgaacattcgtttgaatatcacatgttgaagtcaggtatggcacaatgggttctgagaccagcttttcctcccctcccatttgccttgttccaagctctttcttttcnaattacttttctggatatcataggcaggtatttaattttactaaattagccatcctgtgtgaatgtattaaagaagccactgtgttttagtgtanttngccaaaanataaaagctgttcctnatttgcccctatttttttggtgtcttnaagttatatattnaatcacagagaagcaagggagaaagttnaaagatatctaaggctcatatcacttgattctatggtagattanattagaanncccnaggncnctcgntnatgctngnacatgggcnnatntngtgttccnnntnggnnttcnaagtctananngtnaaatgggtnnnaatttaagtttatatttgcatttccaagcgtttctaaaaatcactaatgccatctatacttttagtatgaaacagcagactatagaaagcacagggaagaataggctaaatacattctttgaagaaccagaggcatataaccacatcattatgtcattcctaatacatggctagattttctaatgataaaattgactgtgtcccaatgcttatttgattctaagcttttttattctgtttctgagatattttaatagctttgcaaaatatgctgaccagtttttggaaaataatggtttttatagcaagcaaagagctttatggcacattttcaaaatagcactcatacatacttacattttgacagaaatgtga

SEQ ID NO: 90 - DNA, 1111 bp, Homo sapiens
  misc_feature: Incyte ID No: 243794.19c
  unsure 519-616, 774-963: a, t, c, g, or other
taccgggcccccccttttttgaagggttttttcaaatgtttattttatatacaaagaattatcatggtttttcattgagtagatgccccggataatcctctgaaggaagagcatttagtccaacttaatgaaaccgatatccttcgcgtactgacggaaacactggcggcacatattgaggccatatttccggatcagaccgtgccggtttgaacagacacgacaagagcgagaaccctggccgaattttcgcgggtggctccagtacagctgctggtgacccatcttgctctcagcagtgcaacgaggtaaaaggaagaagctggcccacgcatgcgctcttcaaatttttgagacagtttacccagaatgcagtgctcaaaggaaacgcgtgcgcagtgtggtcaggttgtttcgctgggtgagtaaaatgaaatcttagaggcgttgtgggctggcccagttgatgacgtcaccataccacagcttctagtgctattctgcgccggtatccgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgagactctatctccaacaacaaaacaaaaacctcttacaaatgaatgagaaaaaagcagatgacctaatagaaacgtaagcaaaatgcttaaacaggcacctcacaacaagtttagccaaatggccaatgaaaaaagatgctct

SEQ ID NO: 91 - DNA, 961 bp, Homo sapiens
  misc_feature: Incyte ID No: 243794.23
  unsure 739: a, t, c, g, or other
ctatggagataaaaagattaaaaacagaaacaaaaaccgaacagtgtgaacagtgcaccctgaggtctccctggggtcccttgtacccctcaggagcctgtggatgaccctgtgcaaacagttgggtggaagactgtgtcttcctgtgtgtttggatgagtaccagaactttctgcgtctgtttttcaccctacccaatgcagtgcttacctaaaaaatgcgttgaatagagcttcttgcttttacctcgttgcactgctgagagcaagatgggtcaccagcagctgtactggagccacccgcgaaaattcggccagggttctcgctcttgtcgtgtctgttcaaaccggcacggtctgatccggaaatatggcctcaatatgtgccgccagtgtttccgtcagtacgcgaaggatatcggtttcattaagttggactaaatgctcttccttcagaggattatccggggcatctactcaatgaaaaaccatgataattctttgtatataaaataaacatttgaaaaaacaagactcgagatcactattcgcttataaaataatcgtcccttacaacaaaaaaagggggcggccacttttgggtgctcagctttctgcggcgggttccgggctgtattccctttatgggcgcccctaaatttactcaggggcgggttttaacagggcccctgggaacccccggtttcacatttacccgtgtagacccctctttcctcctnccccctttgggttccccctttgtgagtccccctttgcacgaccctgtgagacgaccctcttactgattccctgttgggttggcgttctcagggtcccggtggtacacctgatcatcgagcagccactgggtcgcctctctgttcgtggtcacgtcgacgtcgctagcacccgtccccctttctgtttcgtgatgatgtcttcgatcctacggttccgcggct

SEQ ID NO: 92 - DNA, 3041 bp, Homo sapiens
  misc_feature: Incyte ID No: 159309CB1
gcgagcgagagagcaagcaggcagcaggctgccggcgggcgggcggacggcacagagggagggagcgagcgagcagtgagtaagccagcaagggcggtcgggtcccgaggtcagccgagatttctcaggtccctccggccccctccctggagtccacagcgcctccggtgtccagaggatcggacacggcccggcccggccatggcctcgttgctgaaggtggatcaggaagtgaagctcaaggttgattctttcagggagcggatcacaagtgaggcagaagacttggtggcaaattttttcccaaagaagttattagaacttgatagttttctgaaggaaccaatcttaaacatccatgacctaactcagatccactctgacatgaatctcccagtccctgaccccattcttctcaccaatagccatgatggactggatggtcccacttataagaagcgaaggttggatgagtgtgaagaagccttccaaggaaccaaggtgtttgtgatgcccaatgggatgctgaaaagcaaccagcagctggtggacattattgagaaagtgaaacctgagatccggctgttgattgagaaatgtaacacggtcaaaatgtgggtacagctcctgattcccaggatagaagatggaaacaactttggggtgtccattcaggaggaaacagttgcagagctaagaactgttgagagtgaagctgcatcttatctggaccagatttctagatattatattacaagagccaaattggtttctaaaatagctaaatatccccatgtggaggactatcgccgcaccgtgacagagattgatgagaaagaatatatcagccttcggctcatcatatcagagctgaggaatcaatatgtcactctacatgacatgatcctgaaaaatatcgagaagatcaaacggccccggagcagcaatgcagagactctgtactgaggccagggccagggccaggggactctgtgagtctggctcaagaccgacattgccttggtttgttacatgactatcgtgatggggaaactggctggaaatagtaatcacacctctctgtttttagttagagtctaatgaaactctcatctagttctgtgatgtgtttacctcttttttcaggcctcaggaactcttctatttccttccctaataccccacacccaacctgtcgtaatttctggagaactccaggtttgtgtgtgcaggatgttggcacaaaaatacctgtgttttcattctccccctctctccctcctgtgtcttgcgctttatgttttcttccgtttgataattagttggttaaaagctgagggaaccggaaggaaagtgctaggtgttttttaggaactagggtggcggggggacgaacttctcttcctcacatgaggttactgtttctttcctctgtggggcattggatcctcccacagttgccctggtgatgacttagggcttcccatctgtgtacatcccactttgaatcttgatcgtgacaagaaataccttaggccttcagtcaattccgaagctccttcagttgtttttataatgggcgttttcacatgcacatatgtgtatgcatgtatacgcccatacagacatgcacacacagactcctactccattagctaacataccctccctctccacaacccctgtcacatacctttcaggaggtgacagttgtcttagttgtcatctacccagacaaacgtcctgggcccgtcctccctcctgatactgtagcctcttggtacccagggtgagttggtggagaacagagagatgagaagcagagggcttggggaaagcctgttcctctctgactcagccctttttggcattattgcaagagcttgactcctggttgccttttcccagccagttttcagttggggtgaaggtttctgcaagtgtgaggtccagatgctgctgctcatgttgggctttccttttgggaactatttctctttatttatagtgtcgggcttccggggaaagcaatcattggtgtgtatgtgtatgtgcatgcacacacgtgcatatacacatttgtgtatgtggaaatgtgctgggcaagtcaaaactatagaagagttgcctcctgtctctcgaatcttccagagatatcacttaattgttaacagcttttgtgttaatccccttcagcccctagctcttttattctaccacggctggagagttgatacctgcagtcagcctgccagtgactcttagtgtctgtttctgacttatttttcctgtctctgtcttccaacccccaataatatttccaccggggatgcatcatttttactcccaatattctgtagagagggagtcaggatgctgtcttcccacgaatagtactcagtaacaaaccaattgcattttagttgggcagtgctcccacccaccctccagatcccttccagctaaaacccttcccccttccctccatgtgtttctcagtttcccgtttcgtttgttggactgttccactgcccctcctcctcaccctatcacccatggatcgtaatgtaaaattcttttaccatgtcaagaaattattaaaaatacaggtactttgacctctttctaaagccgcagaccctggtgcaatgctctggtggctagggatgtactcatgctcatatgtgtgcacgcttggacacccacctccatggacacctagccaccctgttgtgtgtccttatgccagttgagctgaatcttttccccagtatagtggaaagactgaggcttctgcctactgagcaaggttgggtgcttcatttgtgttcagtctgaattatgggaaagttagctcttcccagacctaagctgccttctctccctactttcagaagatcctagttccttccttcccgagtgatacccatgaactgccagtagaggctgctatcgttccatgtgtaaggaatgaactggttcaaggcgcgtcctacccagtcattttctttaccttatactaattcttcctgaataatgtc

SEQ ID NO: 93 - protein, 254 aa, Homo sapiens
  misc_feature: Incyte ID No: 159309CD1
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 94 - DNA, 1298 bp, Homo sapiens
  misc_feature: Incyte ID No: 1273641CB1
cccggtgcctgcgggattgctggagagaacgcggcgatggagccgggcaggacccagataaagcttgaccccaggtacacagcagatcttctggaggtgctgaagaccaattacggcatcccctccgcctgcttctctcagcctcccacagcagcccactcctgagagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtggtgtctgtgctgtgctgctttggtctctggatccctcgttccctggtgctggtggaaatgaccatcacctcgttttatgccgtgtgcttttacctgctgatgctggtcatggtggaaggctttggggggaaggaggcagtgctgaggacgctgagggacaccccgatgatggtccacacaggcccctgctgctgctgctgcccctgctgtcaacggctgctgctcaccaggaagaagcttcagctgctgatgttgggccctttccaatacgccttcttgaagataacgctgacctggtgggccttgttctcgtccccgacggaatcttatgacccagcagacatttctgaggggagcacagctctatggatcaacactttccttggcgtgtccacactgctggctctctggaccctgggcatcatttcccgtcaagccaggctacacctgggtgagcagaacatgggagccaaatttgctctgttccaggttctcctcatcctgactgccctacagccctccatcttctcagtcttggccaacggtgggcagattgcttgttcgcctccctattcctctaaaaccaggtctcaagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttaggataaaattgctttggatcttgcctggaaggtgttttaagttttgtaataaacaagatgatgtctgaaaatgtgaaaaaaaaaaaa

SEQ ID NO: 95 - protein, 224 aa, Homo sapiens
  misc_feature: Incyte ID No: 1273641CD1
MTITSFYAVCFYLLMLVMVEGFGGKEAVLRTLRDTPMMVHTGPCCCCCPCCQRLLLTRKKLQLLMLGPFQYAFLKITLTWWALFSSPTESYDPADISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNLKA

SEQ ID NO: 96 - DNA, 823 bp, Homo sapiens
  misc_feature: Incyte ID No: 403717.1
ctcctgggccgcgcggctgcagcggggagcgcggactcgggatgtcgggcggtgtccgcgcccctccccaccccagggcccttctcgggggagatatccaggagctgaaagagattcctcaggaggaagtggaaacctctgaaaggagaggaaaccgactcttttgcaagaaaactgagcgccggctggaaggcctaaggaaagcagccgatggctcccaagacaactctgtccggccagtactccagggcaacttcaaccccactaggacccaggccaaaaccatatatatatatatatatgaattaacgcaaaacagagccactttggtgcctacccctccacaagtaggtaggcacatccaggtagctctgtcagaagatgggacctggcgccttgcaggggtagccctatggagatccagaagccccgtttcgagctacgaagtctctcttctactgcagtcttctctccaacgtggagatctagcaacttccctccccctgggattccctgtgaatccactctagttgggatatagcctctctacagctcagtgacgtagcgcgccaaaaccaagtacccaccccggcaactggaagacctagctgtcctccatcccgcctccgcagtcgataatctccaggatccaagcaaagtgcctgtccacgttgtcaccagatccacaagcgcttttgatgagagctgctacccttttggaaacacgattccctctccctagtagagaagaatctattcttctgggctggcgtagacaaagaataaccaagataaagtatgtggtgtgaaaataaataaaaaa

SEQ ID NO: 97 - DNA, 794 bp, Homo sapiens
  misc_feature: Incyte ID No: 047593.1
  unsure 502-546, 605-661: a, t, c, g, or other
ccagcaagtactgagctttaactgtttccaaatggggcttctgagaggcactgagttggcatctaccaaggacttggtctacacatagagggaagacagagaccaggaaacactcatctttctgcaattcaactctgggctccatcttgaaggaaatgaatgcatgaagaacattcttaacctagtatgtctacggccataccaccctaggcgtgcccaatctcgtctgaacccagtacgtgacatgccctatgctgatgctttcatatgcgttaccttatttaatcctcatgacttccacattaataataattacctatgatgtgagagggtcattataccaattttatgaagaaaatatggctcaaagaaataatttttaagtagcaacaccaacatttggaatcttcttgaaacttctaactcctagaagaccaccatgctgtatttttggtctacaaatttaaatggaatagtatctaatgttggggaaaacgggagnnnnnnnnnnnnnnnnnnnnnnnnnnnnnnnnnnnnnnnnnnnnngatgaaaatgttctaaaattgacagtgatgaccattgctcaactccatgaggactctannnnnnnnnnnnnnnnnnnnnnnnnnnnnnnnnnnnnnnnnnnnnnnnnnnnnnnnncacacagagctgttacaaataagtaatatttaatggaggcctcttcccaccctactctacaacagtcacaaaaacctctcaattttcccatatatcctgaagtagaagggcttgccttttatctctttgtaat

SEQ ID NO: 98 - DNA, 3722 bp, Homo sapiens
  misc_feature: Incyte ID No: 347055.4
  unsure 104, 2838: a, t, c, g, or other
gcggggccgggcgggggttccctcgtgagggacctgaggccgaccgtagcggatctgagaagatccgagaacacaggcgacgtcgcaggaggggagaacgcgangagggcgttgaggtctaggtgttctaacgacagaggagttggaggtgccagagaggcagctgtgaccgcctagagtgcccgaaggaggaaacagtgacagacctggagactgcagttctctatccttcacacagctctttcaccatgcctggatcacttcctttgaatgcagaagcttgctggccaaaagatgtgggaattgttgcccttgagatctattttccttctcaatatgttgatcaagcagagttggaaaaatatgatggtgtagatgctggaaagtataccattggcttgggccaggccaagatgggcttctgcacagatagagaagatattaactctctttgcatgactgtggttcagaatcttatggagagaaataacctttcctatgattgcattgggcggctggaagttggaacagagacaatcatcgacaaatcaaagtctgtgaagactaatttgatgcagctgtttgaagagtctgggaatacagatatagaaggaatcgacacaactaatgcatgctatggaggcacagctgctgtcttcaatgctgttaactggattgagtccagctcttgggatggacggtatgccctggtagttgcaggagatattgctgtatatgccacaggaaatgctagacctacaggtggagttggagcagtagctctgctaattgggccaaatgctcctttaatttttgaacgagggcttcgtgggacacatatgcaacatgcctatgatttttacaagcctgatatgctatctgaatatcctatagtagatggaaaactctccatacagtgctacctcagtgcattagaccgctgctattctgtctactgcaaaaagatccatgcccagtggcagaaagagggaaatgataaagattttaccttgaatgattttggcttcatgatctttcactcaccatattgtaaactggttcagaaatctctagctcggatgttgctgaatgacttccttaatgaccagaatagagataaaaatagtatctatagtggcctggaagcctttggggatgttaaattagaagacacctactttgatagagatgtggagaaggcatttatgaaggctagctctgaactcttcagtcagaaaacaaaggcatctttacttgtatcaaatcaaaatggaaatatgtacacatcttcagtatatggttcccttgcatctgttctagcacagtactcacctcagcaattagcagggaagagaattggagtgttttcttatggttctggtttggctgccactctgtactctcttaaagtcacacaagatgctacaccggggtctgctcttgataaaataacagcaagtttatgtgatcttaaatcaaggcttgattcaagaactggtgtggcaccagatgtcttcgctgaaaacatgaagctcagagaggacacccatcatttggtcaactatattccccagggttcaatagattcactctttgaaggaacgtggtacttagttagggtggatgaaaagcacagaagaacttacgctcggcgtcccactccaaatgatgacactttggatgaaggagtaggacttgtgcattcaaacatagcaactgagcatattccaagccctgccaagaaagtaccaagactccctgccacagcagcagaacctgaagcagctgtcattagtaatggggaacattaagatactctgtgaggtgcaagacttcagggtggggtgggcatggggtgggggtatgggaacagttggaggaatgggatatctggggataattttaaaggattacatgttatgtaaatttttatgtgactgacatggagcctggatgactatcgtgtacttgggaaagtctctttgctctatttgctgacatgcttcctgttgtggtctggccaatgccaaatgtactcgaatgatgttaagggctctgtaaaacttcatacctctttggccatttgtatgcatgatgtttggtttttaaacatggtataatgaattgtgtacttctgtcagaagaaagcagaggtactaatctccaattaaaaaattttttaacatgtaagaattttgtactttgaacaacaagattacagaaagtacctgtggtttttggaaaacatttctagcttggggaatgtgacaacattcccccagtgtggtaaaattggggtaaaatgtggtaaaatgtgatacgcacaaaccctttgaaaatagcataacaaacatgccctttttctaaaattgataaatcctaaagaggaagaaaagagctgggacaataaaacactggctctggaatctggaatgttaagtccaggccagcagtgacaaaagttattgtaatgacctctgaacagagaaacactgccattgaagaggcttctggtatagaaaacatggtacattcaggagctgtgaatatagctctaggtgtgctcctgaatcagttcatggtagattatgctgaacaacagtgagatgttattggaggtgtggatgagggagtttgttgttgcagtccttctttgcaccttattttaaagaataaatgaaacatttttctggttacttttttaaaaatttaaaatggaagggaagaataggggcagggcattattaggctatttctgatgcttcagtgttataaattcaacatagaggctgacaacctaaattcatggtgtaacacagctcttttccttttcctttntttttttttttggtatctgttcaatgaaaataaggtatgacccaagtttttacctagtctgactagaagtattccacttcaaggtctgaagtaggacttttaccttaaaaaacaacaacaaacaaaactatcacacaggatagataagaagattggttaaacagttttgtgtagatctttttggtgctgaactatgacatgagccttatagattgtaaaatagggatagttggaactaatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtgggaaaatggtgcatgtaatacttttgcaagtgttggggagatcggtatgttttgaaaagagtaatttaacttttgggtgccaggaaatgggttttctcaaagtccattgccggcaatgggcaggcctgcaaatactggcacagagcattaatcatacaccttattaacggtgaggtgaataactttatttcaaagttattcacctcaccgttaataaggtgtatgattaatgctctgtgccagtatttgcaggcctgcccattgccggcaatggactttgagaaaacccatttcctggcacccaaaagttaaattactcttttcaaaacataccgatctccccaacacttgctgaactatgacatgagccttatagattgtaaaatag

SEQ ID NO: 99 - DNA, 1498 bp, Homo sapiens
  misc_feature: Incyte ID No: 898899.11
gtcacgggctcaaggctggaggctggcgggctagggctgagtggagcgcctgcttagagaccttcgggagaacttctgccggaaccccgacggctcagaggcgccctggtgcttcacactgcggcccggcatgcgcgcggccttttgctaccagatccggcgttgtacagacgacgtgcggccccagggtgaggcccaagcttgggggctacagagccgggctggaagcctggaaccggagggccggggcgaggtctcggcctgatggctgcccgcacccgccacagactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcgggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccgcctgaatgatatgtggtgcctccagggaccaagtgtgagatttcagtccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtggggccctgtgagggtgactacgggggcccacttgcctgctttacccacaactgctgggtcctgaaaggaattagaatccccaaccgagtatgcgcaaggtcgcgctggccagccgtcttcacacgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcct

SEQ ID NO: 100 - DNA, 3042 bp, Homo sapiens
  misc_feature: Incyte ID No: 898899.32
  unsure 865, 881, 888-889, 897, 1850, 3016: a, t, c, g, or other
tcgatctacaaggtcgtgacgggaaaaaggggcacctcaagtgtccccaccaaacctggctgacacctgacactaagtagggaggcctctcagggggctagctgtgctaggcccttgcaactgacctgtgggacctgaggcctggcccctcatggctcctgtcaccaggtctcaggtcagggtccagcaggccctgagctgacgtgcggagccagagccacccaatcccgtagggacaggtttcgcaacttcccggatggggctgtggtgggtcacagtgcagcctccagccagaaggatggggtggctcccactcctgctgcttctgactcaatgcttaggggtccctgggcagcgctcgccattgaatgacttctaggtgctccggggcacagagctacagcgccgctacaagcggtggtgcccaggccttggcaggaggatgtggcagatgctgaagagtgtgctggtcgctgtgggcccttaatggactgccgggcgttccactacaatgtgagcagccatggttgccaactgctgccatggactcaacactcaccccacacgaggctgcggcattctgggcgctgtgacctcttccaggagaaaggtacatgcccacgctccggaatggcctggaagagaacttctgccgtaaccctgatggcgaccccggaggtccttggtgccacacaacagaccctgccgtgcgcttccagagctgcggcatcaaatcctgccgggtggccgcgtgtgtctggtgcaatggcgaggaataccgcggcgcggtagaccgcaccgagtcagggcgcgagtgccagcgctgggatcttcagcacccgcaccagcaccccttcgagccggngttcctcgaccaaggntcctggnnacgacagnactattggcccggacatccgtggacggctccgaccgggccatggtgctacactacggatccgcagatcgagcgagagttctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggccggacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagggccggggcggggtctcggcctgatggctgcccgcaccggccgcagactgctaccacggcgcgggggagcagtaccgcggcacggtcagcaagacccgcaagggtgtccagtgccagcgcgcgtccgctgagacgccgcacaagccgcagtgaatccctggtgctcccggccccgccaggccnctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcgctgatgaccagccgccatcaatcctggacccccccagaccaggtgcagtttgagaagtgtggcaagagggtggatcggctggatcagcgttgttccaagctgcgcgtggctggggggccatccgggcaactcaccctggacagtcagcttgcggaattggcagggccagcatttctgcggggggtctctagtgaaggagcagtggatactgactgcccggcagtgcttctcctcctgccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagagatctgtgaccctgaaccagcgtgtggccctgatctgcctgccgcctgaatgatatgtggtgcctccagggaccaagtgtgagattgcaggccggggtgagaccaaaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggttgagatttaataaaattaatatttttactacttcaccaaggactttcttaaacgaaaatggtttttncccctgcaagtaaacagtaatgaaga

SEQ ID NO: 101 - DNA, 1952 bp, Homo sapiens
  misc_feature: Incyte ID No: 2047630CB1
gtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgaacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgattttcttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtgtgaaaaaaataaaagtcctaaatctaaaaaaaaaaaaaaaaaa

SEQ ID NO: 102 - protein, 561 aa, Homo sapiens
  misc_feature: Incyte ID No: 2047630CD1
MCGIWALFGSDDCLSVQCLSAMKIAHRGPDAFRFENVNGYTNCCFGFHRLAVVDPLFGMQPIRVKKYPYLWLCYNGEIYNHKKMQQHFEFEYQTKVDGEIILHLYDKGGIEQTICMLDGVFAFVLLDTANKKVFLGRDTYGVRPLFKAMTEDGFLAVCSEAKGLVTLKHSATPFLKVEPFLPGHYEVLDLKPNGKVASVEMVKYHHCRDEPLHALYDNVEKLFPGFEIETVKNNLRILFNNAVKKRLMTDRRIGCLLSGGLDSSLVAATLLKQLKEAQVQYPLQTFAIGMEDSPDLLAARKVADHIGSEHYEVLFNSEEGIQALDEVIFSLETYDITTVRASVGMYLISKYIRKNTDSVVIFSGEGSDELTQGYIYFHKAPSPEKAEEESERLLRELYLFDVLRADRTTAAHGLELRVPFLDHRFSSYYLSLPPEMRIPKNGIEKHLLRETFEDSNLIPKEILWRPKEAFSDGITSVKNSWFKILQEYVEHQVDDAMMANAAQKFPFNTPKTKEGYYYRQVFERHYPGRADWLSHYWMPKWINATDPSARTLTHYKSAVKA

SEQ ID NO: 103 - DNA, 2764 bp, Homo sapiens
  misc_feature: Incyte ID No: 1039889.8
ctagtctcgcactctgttcttccgccgctccgccgtcgcgttatctctgccggtcgcaatggaagaagagatcgccgcgctggtcattgacaatggctccggcatgtgcaaagctggttttgctggggacgacgctccccgagccgtgtttccttccatcgtcgggcgccccagacaccaggtgagtggatggcgccgcggggctcctgggttctgcgttgcggggtgggttcggtgtcgccggcgaggctgacgggtcgtcccctgcagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcaggtgaggctcggcagacgcccgtgctcctcccgtcctttccccagtcattttctgcccatcttgatttctgacatttaagtgtttctttcgctgttccaggctctgttcctctcccggcatttcctccctgaagcctccaggtttctcatttggtttctgcctgcgttcttttcttttctccacacatcacactggcatgcagcatgttgtggcgtgtgagcatggggtggccgtgggtctctgtccctgactaagccgccccttgtcccttctcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctacactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtaggtgttgtgagctaaaggtttctactcttacatcctcggtgacacagcatcactaagggagggctctgtcccctaggtatggaatcttgcggcatccacgagaccaccttcaactccatcatgaagtgtgacgtggacatccgcaaagacctgtacgccaacacggtgctgtcgggcggcaccaccatgtatccgggcattgctgacaggatgcagaaggagatcaccgccctggcgcccagcaccatgaagatcaaggtgagtcgaggggttggtggccctctgcctggctcgggagagctgactggggggcgctctgtgagctgaagccgtgcctggctgtctttgcagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggccaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaaggaaattcagccctaaaatgtatttctctctgtgtacgagtacacaatcatgctgtttattaaactatcttgcttacatctttaagtattttttatttactttattagtaacacttatttgaaaaagtaattgggagagaaaaatgtgttggatttatgcctctgatgtatcacatgcaggttgtcagctctggttcaagtgtgtaatctctatacattgctgacaagcgagagaacgagaaggatataaatggagagtatgtgaatggattttattttttcaagcccctgtgtgagtttgcaactgtgctggtaaggaccagttctttcattgtg

SEQ ID NO: 104 - DNA, 1450 bp, Homo sapiens
  misc_feature: Incyte ID No: 1272969CB1
ctcgggtcgcgcggctcgcgcaggccgccaccgtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggaaaaaaaaaaaaaaa

SEQ ID NO: 105 - protein, 430 aa, Homo sapiens
  misc_feature: Incyte ID No: 1272969CD1
MSFTTRSTFSTNYRSLGSVQAPSYGARPVSSAASVYAGAGGSGSRISVSRSTSFRGGMGSGGLATGIAGGLAGMGGIQNEKETMQSLNDRLASYLDRVRSLETENRRLESKIREHLEKKGPQVRDWSHYFKIIEDLRAQIFANTVDNARIVLQIDNARLAADDFRVKYETELAMRQSVENDIHGLRKVIDDTNITRLQLETEIEALKEELLFMKKNHEEEVKGLQAQIASSGLTVEVDAPKSQDLAKIMADIRAQYDELARKNREELDKYWSQQIEESTTVVTTQSAEVGAAETTLTELRRTVQSLEIDLDSMRNLKASLENSLREVEARYALQMEQLNGILLHLESELAQTRAEGQRQAQEYEALLNIKVKLEAEIATYRRLLEDGEDFNLGDALDSSNSMQTIQKTTTRRIVDGKVVSETNDTKVLRH

SEQ ID NO: 106 - DNA, 6290 bp, Homo sapiens
  misc_feature: Incyte ID No: 282397.85c
tttttgaaaattggagataaaatttttattacttgtaaacaaaattctgtcaaaaacctgacaaattaaacaatacaattaatatgtttaatagaactaattacatatgagaggcatccaaaatccattttttctatacaaacatggtttgatatacagtcattttatctgtgtattaattggtttatgaaataacaaatagaaaaatcaagtatgcattatcaagttaaagaagcaggagagatggagctataaaaacaaagagagaagaatgttgtaaggagggcttaacaaccaggataaatgttgtagaaagatcaattaaagtgatggcctagagatcacgggcttcctttggcagagccatgttggtgaagtgaaggaagtggaagccagaccacaatggttgaagaatgaatgtaatgtaagagccaagacatttatttgagtctgatagtaatgaaaaaggacaagaattttcttcttgctgttgtttttgtcatttcatgttcaaaaccctttatctcccatgtggtactgaaaactccaagatgggatctctgtttctgtgaggcctgtagtgcttagtacatccttgaatgtgtgaggctctcattggtataagtttaattcctgactgtggatgaaagctttaaaactttgcgggcaaaatacagaatgaatttcagtgagttcccatgtattaaacaaggtggcgctggctggagacatgctgtccctgtgcccacaggagtagcagtgctgtgctcatcttcctgacccgctcttcacagtcttcaccgcctttcttcaggagtctcccctttggcttttccacagctatgaaacccacgtagtcggacaccctaatgcttctcctttcctgtttgggcgagatttataggaagtgtttcttctgctgaagcctggttcatttattctgccaaatgtatgcctggtattgtgttttttggtcttgaaacacgtttcacaaaaatcaaagtcatcacagtttctgcatttgaatctggatccattgataggaaacatctgacatccatcacacctttcacaacccccacactctgatgagtcacagatccccatttgtattttggtgtggtgacagaggctttgacccgcactttatcaccaatcttgatgtgagaagaacttcttggtggaggatagcctataagttccacatgaatgtacctaaaccagtagatgccccctttctgctgccagtcacactgcacattgagatcatgcaatccatctctgtccagcttgatgactttgccaacatcacatcaccttcgcacacttcttcgtatgttcggcagcatctaaccatcattcccacctgaatattctctctcacatatacagcataatcatcattacccaagaaaccagctcggtttttgtacgtctggctctccgtcacaacagcaccagtagacatggagtaggcggcatcatccatgtcctccaccacctcctcgtcagaatactcgtcggacaccgtgtctgcatctgagagctccgtgacctgtatgtcggagtggtccagcagccacccgaccaaggcttccacaccaggcaagccggacgcattcccggaagcaccagtgagagacttcagggcaaactcgatgttccttctgggaaatcccatctccatgagctgcaccacgatcggcagagcgggaacgggtgactgcttgcgcctcttcactctggcagggcggatgtgctgcacgttgacaggcgtggtggcctcactggagctgcagtcttcaaatcctgggctcgaagggtgagtggactccacaacggccagtgcagcagtctcaagttcctgtttatcaaatatggccttcacaggagacggctgggtggccgaggccagcagctgctgcaagaggatcatggggggctgcggcccttcaggagacatgtccccaaggtcaggtgataccactgctccatcatctgtgtgaacagttccagtctcctgaacagctggctgagacaggatctgccgcagtttatcctggtgggagaacagcgcccgacctgctttcaggatgtatagcttcaactgctggcgccgcagcaggtccaggtccacttgtcctgcaaaggcctgtttagtcgatttctttattttgtgcttttctaacttgcttccagcgaggttcaccaactgagcccagacagacagcatgggctctgtgaagggcaggttgttcacattaaaggccacggcagggagtggtttcagctgattcaatgggcaaacgcgacacgtccgcatgtcagagaactgcacggtgattttgcccttcagggtgatgcgagtcatggtgacttctccaaagtcatcgtgcacaacttggccgcccaggcacaggcgaccatcgatgcctccaaccacagccaggaccgccatgaggccccccacttcagggttctcggaatcagggaagtagtcatctaactgggcccctttggaaggccttcccgcaaagctgtgggtgatggagcggagctgggagttgatgtacttgttgatgagcccattccaccgagtcagggagtgcagcgtgtgcagcagtgccaccacctcctccgccagtgtgctgctgtgggtggcagtcagcgaggcctgcgggcacaccctgcgccgcctcagcgtggactctgaggaggaaaccaggggagaagctgctgcaccactcttcaccagggcacagggaagggagacggccactcacctctgagtgacggcactacacggctcttcaccaggacacagggaagggagacggccacccacctctgagtgacggcactgcaccgctcttcaccagggtacagggaagggagacggccacccacctctgagtgacggcactgcaccgctcttcaccaggacacagggaagggagacggccacccacctctgagtgacggcactgcaccgctcttcaccagggtacagggaagggagacggccacccacctctgagtaacggcacgtcagaggagcacatagtgagcaagctccccaagaagtcaaacagcttctccatgaggcatttcatgtccctcaccctttcggtcttgtcccatgacggaaggactgcttgcaacaaatgcacagctaagatctgcctctgcagcgaggtggcagtgaagggtgcgtgcccttccacaaccttcatgagcagcgtgatccactgcggggagctgagggcgccgcacacctgcagcgtgagagcgatgctctgcacaaaccccagcgtgcaccagctccggtgttgctccctgtacaccagcctgtttggagaagatgtcttgtccgtcgttccgctttccactaacattcgcagcagtccgcataaagtcttggtggcttcactctgcatgatctcagcatgaactccagcagacagacaaagagtctgcagtaagttaatagtgctggtaaacatcattgcagtggggtgaatgttcctttcagtttgttcggcttcagagtcgtcctctgtgtccgaatcctctgctgagggctgtgcaggggctggcagctctgccagcttgaggtcgtattttccttctttccccatcctgtaggagttggtgctgcctgtgtcccactggactcttatccacccgtcctctcccagctcaccaatcactcggcctaggcctggaggaggcccatcctgatcgccccatttccagtccacacctctcatgacccttgttccaatcttcatcatggcagccagttctggccctgaaacagggagctgcacaggagccgtttccttccttgtttcttccaaaactgtggcagaagcaccttgggcagaagcattcatatcttcctcaacgctgtcacaactggggccaatcaggcgcagtgccgtctgagcgagggccagcgtgccggaattgagcaggaggtcaaggttgtttgcgctgtgctgcagggtgagcatgctgagcatcaccaggaggaagtgggcttgcgggatggtccccaggctcggtcccgatgggttctcattggtgatggtttgcaggggaaccggctggataccaagctctttaaatttggcactggcatccaccaaaacatttcgaatgttctgaacagcccaagcgtacagcttgccaaaggtgacttccagcagcatccgattaaaaggcgggatcaaatcaacatcctttaaacaatcagtaagaggttcccctatatcgattccctcaggaataagtctttgccatccacaaaacatcgcatacggcacagatggaagtaagaaattcttgctcaccagatacaattttaaaattgtatctatcccttccaggcgaacctctgctctctccaactgttttagtaggcactttctcttttccacatccactggctcttctttaagggcaaattcagcaattgtactgaggagtggagactgcggataaagaccctgcacattctgcttcaaccacttgtatttgtgaacatctgtaacagtactcaacagcggctgccatttgtccttgggtgatttaattgcaatgggtctcttgtccacatttattggactatgaggcaaaatgcaagcttcttctaaatcactctcttcgtttccaattttttcttcatcatccgtagattctggcttcttaggaactctctttttccttggttctcgaattatcttctgagctatcctcctccaatggggcaaagaacttaacaatttaaacttagacattatagagaggtcattacaaacagcaggtctcaattcattaaagaggaatctcaaacgtttgatgacaggagcgcagacctccttgtaagaacggccctgttcttgatgagtcttaatgagcgaacattttgcttggtagacaactctacaaacatccaccactgacttaggcaacgttctgtgctttacttgctcaatatcaagtgcacctgcatgaactaaagataatgccacatgacctaaatcttcatgttttaagaggcaacataacagcaagcgaccgacctcttccacgggatgctcggggggaaacatgatcggtgtggtcaaatggcactgcctacagtacctttctatttgacacaaaaagtccttcacgttgtgatcctgaatgttgttgtctgcaatggcttgcagaaatgcctgggaatggtcccccagggcccgtctgtgggagcagagtcgagatttgctggcaggtgtgccccctggggagctgcagtggtcctcgtctttctcctcgttgtagctgtagtggatctggctggtctgcaggcctccagagaagatggatgactgaagccatttggcacattcaatctcgacaggagacagcggtgtgctcattgctaaataggaagcgtgtaatccgagaagcaggcccagattcctctctgtgtctatcagaggtgaggagagactccccagatctggtatggtgacgccttcttggtcaggctccaaatactggccaacacaaaatgcgtgcatggattcccgggtgtcttcaaactgcaaagcagcttccaaagctaccactgggtcttcccctgcaaactgagcaagaatactattttctgttaacgactgtgtctggaagtcctttatatcatacactttcccgtcaatcacagtccagaagcctccatcgttattatggttctccaaatcagctatgcgtacaaatgtcactttctcattatttctacagttctgacctgtaaaaaatgactcttatgagacgtcggagagctacacagaggaggcatctacagggtgtagccagacggtctaaatgggccatgacaacaaccgccgtttgttgcagatcaatggcaagcctgttgtcttgtggaagggtgaggtacctcaggaaactctcactggggctcagaggaccagacaaaagcttttccaggagggagctatccgttctgggttgattctgttccagtgtatacaatttctccatctttaaccatttcattccacagaccacagagcccatctcttgtgaatgcaagctgtatatctgttttcaaccatttggagtcgaggcgagcctgggcagccaaacacaaagattcagagggcatcttttctccagcttcctcccaggtctcaggcctgacgcgcagggccgggccgcctcgccccgccggcgtgcggacgcagcctcccaagagccgctggctcagccggcgcccg

SEQ ID NO: 107 - DNA, 622 bp, Homo sapiens
  misc_feature: Incyte ID No: 282397.94
ggaaaatacgacctcaagctggcagagctgccagcccctgcacagccctcagcagaggattcggacacagaggacgactctgaagccgaacaaactgaaaggaacattcaccccactgcaatgatgtttaccagcactattaacttactgcagactctttgtctgtctgctggagttcatgctgagatcatgcagagtgaagccaccaagactttatgcggactgctgcgaatgttagtggaaagcggaacgacggacaagacatcttctccaaacaggctggtgtacagggagcaacaccggagctggtgcacgctggggtttgtgcagagcatcgctctcacgctgcaggtgtgcggcgccctcagctccccgcagtggatcacgctgctcatgaaggttgtggaagggcacgcacccttcactgccacctcgctgcagaggcagatcttagctgtgcatttgttgcaagcagtccttccgtcatgggacaagaccgacaaggttagggccatgaaattcctcattggagaagctgtttgacctctttggggagcttgctcactaaggggctctcctgaactgtccgttaatccaaaagtgggttggccgtctcccttcc

SEQ ID NO: 108 - DNA, 1521 bp, Homo sapiens
  misc_feature: Incyte ID No: 1448817CB1
cccatccagcgagcatctgcggccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttaaaaaaaaaaaaaaa

SEQ ID NO: 109 - protein, 259 aa, Homo sapiens
  misc_feature: Incyte ID No: 1448817CD1
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 110 - DNA, 919 bp, Homo sapiens
  misc_feature: Incyte ID No: 1100769.2
  unsure 867: a, t, c, g, or other
cgcggcgcaagggcttgctgggagacacataacctcgattttcttccgccatccggctaaatagtcccatgtgcactttgttccatggataaataaacactaggaacgcatttccaccctagatttcagcagaaatgctgaatgtaaaggaatatttgagtaaagtgagttgccgttcttgaagcccgtctcctaaggattctcccggtgtccgcgtagggatctcatgctatataggagggccctgccaggcaccgtctcctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagcgagcntcttcgatgcctatgtgcttcccaagctgtatgtgaagctacattactgtgt

SEQ ID NO: 111 - DNA, 1456 bp, Homo sapiens
  misc_feature: Incyte ID No: 332521.1
  unsure 128, 131, 141-160, 910, 923-947: a, t, c, g, or other
gcgggtagtgaattatctgtgcctagacccaaactgaaagtgtctcaggcaggaagttccaagggatgtatgtttatagcatccaggcaatgatctttttttttccacgaactaaaatacctcttttnggnatctattgannnnnnnnnnnnnnnnnnnngctctctttcaccttgcacctctccctaatgctctctaaatttgtccagagctttctttttcctagaaatccagagagcaaagtcagagcctggcacctgcagataggataacactggtgtctgatggtgaggctgcccagtcccatcaggagcctcagccaaggaggggcctgggcacactcaggtccccatggttgtccattgaatggagtgaggatcaaggtgggaatgactgggtggtggctgccactagcccaggaacatgacaacgtgaccacaccacacatgcctccaacacacacccacagtctaaacatctctccttctcagtgagcccttctcccattccagatcatcagcacacccacacccaccataggtctctcttctccggtcttcccagaagggtaaaactcccagcctaccctgctccagcttcagcccaggtagttggtgtgtctcaatatgaatagggggtgagtagcttcatagaaagaatggggaactcccttggcctcaagccagtatagtttggaagttgggggtcggggatgttaagggtggggagtatcctgcctgtgacctctaggttatgaaaactatcttagaaggtgcttttagaaagaaccaggagaacaaccaaagcagcttacagacgcctgaacggagaatgaagtgtttcaagtaagcgagtctgcaagttctcagaagcagacagatatccaatctggactgcagccagggaagtnctctctctcgctnnnnnnnnnnnnnnnnnnnnnnnnnattgcttgtatgacttcacaagcaactcaggatcattctagcaggctttcccactgtcaaacagagacttcattctaaaaagagaagtgataaacagagctccagctctgctagctctatatatttactgattagtggaaagcactgaccaaggagacttttaagccagtggttcttcagaatcacctagatgcctccaccctccagagatccagagtccaggagtctgaagtggggccccaggtgatgtcattgctgctggtccccaggacccacattttaacaatcaatgttttcagatgtctcatgaggaacactacttaatgcagtgggaaagaaaatatttcagaggagaattttttcttaaagaagctgcatattctggactctaatttagtttaattcactccaggatggcacgcaggattcctaattcttaaatgccattcagtctggacttcaaatcacttgtcttcagaaaataaaagatttgttccacctcgggtgtg

SEQ ID NO: 112 - DNA, 4346 bp, Homo sapiens
  misc_feature: Incyte ID No: 225080.16
ctgcagagtggcttcctgccttactgtgagcccgtctaccagcgctgtgtcaccctggtgcagaagacactggctcaggccatgatgtacacccagcaccctgagcagtatgaggctcccgacaaggacttcatgatgcgtagagcactgcagcagcaatgacggagggcacgtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccaagaattactttaaggacttgcccaaagcccacaccgcctttgagggggctctgaacgggatgacattttacgtggggctgcaggctgaggatgggcactggacgggtgattatggtggcccacttttcctcctgccaggcctcctgatcacttgccacgtggcacgcatccctctgccagccggatacagagaagagattgtgcggtacctgcggtcagtgcagctccctgacggtggctggggcctgcacattgaggataagtccaccgtgtttgggactgcgctcaactatgtgtctctcagaattctgggtgttgggcctgacgatcctgacctggtacgagcccggaacattcttcacaagaaaggtggtgctgtggccatcccctcctgggggaagttctggctggctgtcctgaatgtttacagctgggaaggcctcaataccctgttcccagagatgtggctgtttcctgactgggcaccggcacacccctccacactctggtgccactgccggcaggtgtacctgcccatgagctactgctacgccgttcggctgagtgccgcggaagacccgctggtccagagcctccgccaggagctctatgtggaggacttcgccagcattgactggctggcgcagaggaacaacgtggcccccgacgagctgtacacgccccacagctggctgctccgcgtggtatatgcgctcctcaacctgtatgagcaccaccacagtgcccacctgcggcagcgggccgtgcagaagctgtatgaacacattgtggccgacgaccgattcaccaagagcatcagcatcggcccgatctcgaaaaccatcaacatgcttgtgcgctggtatgtggacgggcccgcctccactgccttccaggagcatgtctccagaatcccggactatctctggatgggccttgacggcatgaaaatgcagggcaccaacggctcacagatctgggacaccgcattcgccatccaggctctgcttgaggcgggcgggcaccacaggcccgagttttcgtcctgcctgcagaaggctcatgagttcctgaggctctcacaggtcccagataaccctcccgactaccagaagtactaccgccagatgcgcaagggtggcttctccttcagtacgctggactgcggctggatcgtttctgactgcacggctgaggccttgaaggctgtgctgctcctgcaggagaagtgtccccatgtcaccgagcacatccccagagaacggctctgcgatgctgtggctgtgctgctgaacatgagaaatccagatggagggttcgccacctatgagaccaagcgtggggggcacttgctggagctgctgaacccctcggaggtcttcggggacatcatgattgactacacctatgtggagtgcacctcagccgtgatgcaggcgcttaagtatttccacaagcgtttcccggagcacagggcagcggagatccgggagaccctcacgcagggcttagagttctgtcggcggcagcagagggccgatggctcctgggaaggctcctggggagtttgcttcacctacggcacctggtttggcctggaggccttcgcctgtatggggcagacctaccgagatgggactgcctgtgcagaggtctcccgggcctgtgacttcctgctgtcccggcagatggcagacggaggctggggggaggactttgagtcctgcgaggagcggcgttatttgcagagtgcccagtcccagatccataacacatgctgggccatgatggggctgatggccgttcggcatcctgacatcgaggcccaggagagaggagtccggtgtctacttgagaaacagctccccaatggcgactggccgcaggaaaacattgctggggtcttcaacaagtcctgtgccatctcctacacgagctacaggaacatcttccccatctgggccctcggccgcttctcccagctgtaccctgagagagcccttgctggccacccctgagaacatgcctacctgctgggtgccgtctgtgcgttccagtgaggccaaggggtcctggccgggttggggagccctcccataaccctgtcttgggctccaacccctcaacctctatctcatagatgtgaatctgggggccaggctggaggcagggatggggacagggtgggtggcttagactcttgatttttactgtaggttcatttctgaaagtagcttgtcgggcttgggtgaggaagggggcacaggagccgtgacccctgaggaggcacagcgccttctgccacctctgggcacggcctcaaggtagtgaggctaggaggttttttctgaccaatagctgagttcttgggagaggagcagctgtgcctgtgtgattccttagtgtcgagtgggctctgggctggggtcggccctgggcaggcttctcctgcaccttttgtctgctgggctgagggacacgagggcaaccctgtgacaatggcaggtagtgtgcatccgtgaatagcccagtgcgggggttgctcatggagcatcctgaggccgtgcagcagggagccccatgcccctgggtcgtgagcttgcctgcgtatggggtggtgtcatggagcctcatgcccctgggtcgtgagctcgcctgagtatggggtggtgtcatggagccgcatacccctgggttgtgagctcgcctgcatatgcagggtctgtcatggaacatcccaagtctgtgcagcagggagccccatgcccctggggacatgaacccacctgcgtggaatgctgtttgtgaggtgtctacagggtttatagtagtcttgtggacacagaaatgcacaggggacacttacggacacagaaatgcacaggggaggccgagcataaccaggggtgaggggcaggcagcagttgtagttactgccgcggggcactgctatgtgcagggacagccagcacccagcccatcaccactccctgggctggctggcaggtatggcaccctgggagcccggcatatacccagggcacccctacggctgccgccagtctcatgcccaggtgggtgctctgggctggagcgagggccaggttttgggccgaggcttccccaggcaatcctgtgagctcccttctagcctctgacccagtctggtctggcttgcatggatgtagggcttggggtgggaagttcaggtcctggctttgcctttgcctgatgtggatgagcagctcacatgctcagggccacctgagactgtcactgctctcccctggctactgggaggagtcactgagagcttcgttacccctgctgccttgcccagggcacaccctatacctcctcatctgctcttcccctccctgccgccttctgggcaggtagcagtccctggcctctccccctggctgatcactctccctcaggcagtggagatctgcgtctggacaccctcagatcctgtcattgcctgcccagagtccttcaggggcacccctctgccttggtgtgcagtccagggctctcacccaggtgccgcaccctctggggtcttctgtccagctcccttgccccatgtgctgtcactgactctccttgggactcgcctgcctgctcagagccctgcagggcttggtcagctgcctgttcagtgtcaacacttccctgcacatcttaaaactgggctttattttcgctgaaggaactgtgttgggacccttgacatctgtcaggtttgcacatgctgtttttttttctcagcccacgtgttctcccccacgtggggtagcagcaggacagacagtgaatcacagagtctgccctgagcagaggctgctgtccctgggactcctagccatggtcagactgtacaaaacggttttccagaaatgaaatgtaaatccatttttatactgaaaatgttactgaaagtcacttttatgagcatctgccttaataaacagacattgattcccttaaaaaaaaaaaaaagg

SEQ ID NO: 113 - DNA, 2624 bp, Homo sapiens
  misc_feature: Incyte ID No: 334851.5
ggagctacatggcaacctcagcagaaactctccatcttccagcttgtcccctggctcagggggcacatgactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctg

SEQ ID NO: 114 - DNA, 996 bp, Homo sapiens
  misc_feature: Incyte ID No: 995529.7
gccgcggaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataat

SEQ ID NO: 115 - DNA, 1825 bp, Homo sapiens
  misc_feature: Incyte ID No: 995529.8
ggagcggccgccgcggtaataataagccgggatctaccatacccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttgggatttgctctcgaaaatgttaatctatgatccagccaaacgaatttctggcaaaatggcactgaatcatccatattttaatgatttggacaatcagattaagaagatgtagctttctgacaaaaagtttccatatgttatgtcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcagagtaataactgaaggaggtgcttatcttggctttcgagtctgagtttaaaactacacattttgacatagtgtttattagcagccatctaaaaaggctctaatgtatatttaactaaaattactagctttgggaataaactgtttaacaaata

SEQ ID NO: 116 - DNA, 4416 bp, Homo sapiens
  misc_feature: Incyte ID No: 201851.1
cggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcccttaagaaccacggtcaacaatggcactgtgttaccaaagaaacctactggctctctaccatccccctccgggttcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaacctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgttttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgcaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattggcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttatt

SEQ ID NO: 117 - DNA, 1606 bp, Homo sapiens
  misc_feature: Incyte ID No: 059509CB1
caactcattcgctttcatttcctcactgactataaaagaatagagaaggaagggcttcagtgaccggctgcctggctgacttacagcagtcagactctgacaggatcatggctatgatggaggtccaggggggacccagcctgggacagacctgcgtgctgatcgtgatcttcacagtgctcctgcagtctctctgtgtggctgtaacttacgtgtactttaccaacgagctgaagcagatgcaggacaagtactccaaaagtggcattgcttgtttcttaaaagaagatgacagttattgggaccccaatgacgaagagagtatgaacagcccctgctggcaagtcaagtggcaactccgtcagctcgttagaaagatgattttgagaacctctgaggaaaccatttctacagttcaagaaaagcaacaaaatatttctcccctagtgagagaaagaggtcctcagagagtagcagctcacataactgggaccagaggaagaagcaacacattgtcttctccaaactccaagaatgaaaaggctctgggccgcaaaataaactcctgggaatcatcaaggagtgggcattcattcctgagcaacttgcacttgaggaatggtgaactggtcatccatgaaaaagggttttactacatctactcccaaacatactttcgatttcaggaggaaataaaagaaaacacaaagaacgacaaacaaatggtccaatatatttacaaatacacaagttatcctgaccctatattgttgatgaaaagtgctagaaatagttgttggtctaaagatgcagaatatggactctattccatctatcaagggggaatatttgagcttaaggaaaatgacagaatttttgtttctgtaacaaatgagcacttgatagacatggaccatgaagccagtttttttggggcctttttagttggctaactgacctggaaagaaaaagcaataacctcaaagtgactattcagttttcaggatgatacactatgaagatgtttcaaaaaatctgaccaaaacaaacaaacagaaaacagaaaacaaaaaaacctctatgcaatctgagtagagcagccacaaccaaaaaattctacaacacacactgttctgaaagtgactcacttatcccaagagaatgaaattgctgaaagatctttcaggactctacctcatatcagtttgctagcagaaatctagaagactgtcagcttccaaacattaatgcaatggttaacatcttctgtctttataatctactccttgtaaagactgtagaagaaagcgcaacaatccatctctcaagtagtgtatcacagtagtagcctccaggtttccttaagggacaacatccttaagtcaaaagagagaagaggcaccactaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtgcaaaaattagctgggtgtgttggcacatgcctgtagtcccagctacttgagaggctgaggg

SEQ ID NO: 118 - protein, 281 aa, Homo sapiens [sequence omitted]

SEQ ID NO: 119 - DNA, 593 bp, Homo sapiens
  misc_feature: Incyte ID No: 481231.14
aggaggtgcgtcctgctgcctgccccggtcactctggctccccagctcaaggttcaggccttgccccaggccgggcctctgggtacctgaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagcccgcgctcgaggacctccgccaaggcctgctgcccgtgctggagagcttcaaggtcagcttcctgagcgctctcgaggagtacactaagaagctcaacacccagtgaggcgcccg

SEQ ID NO: 120 - DNA, 2218 bp, Homo sapiens
  misc_feature: Incyte ID No: 280276CB1
tgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctaaaaaaaaaaaaaaa

SEQ ID NO: 121 - protein, 644 aa, Homo sapiens
  misc_feature: Incyte ID No: 280276CD1
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRGIHTSPLGKPSLSP

SEQ ID NO: 122 - DNA, 1712 bp, Homo sapiens
  misc_feature: Incyte ID No: 4675668CB1
ctttcttcagtccccacgtgcgatccttcccggcaactttttcgagaaaaatgcccaaattcaaggcggcccgtggggtggggggtcaggaaaaacatgcgcccctggccgatcagatcctggctgggaatgcggtgcgggcgggggtccgggagaagcggcggggtcgcgggacaggagaagcggaggaagagtatgtggggccccggctgagccgacggattttgcagcaagcacggcagcaacaggaggaactcgaggccgagcatgggactggggacaagcccgcggcgccgcgggaacgcaccacgcggctgggtccaagaatgcctcaggatggatcagatgacgaggacgaggagtggcccaccctggagaaggctgccacaatgacagcagcgggccatcatgcagaggtggttgtggaccctgaggatgagcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttgctgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagtcccccgcgatgtggaagatgttcccatcaccgtggagtgaggaaaacagtcagctgtcctggccaaaggggtttggaaggacaccaagacccccgttggtgactgaagatgacactgagctttaatggctgaagacccagatcagggcagtgacagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattgaaaaaaaaaa

SEQ ID NO: 123 - protein, 437 aa, Homo sapiens
  misc_feature: Incyte ID No: 4675668CD1
MPKFKAARGVGGQEKHAPLADQILAGNAVRAGVREKRRGRGTGEAEEEYVGPRLSRRILQQARQQQEELEAEHGTGDKPAAPRERTTRLGPRMPQDGSDDEDEEWPTLEKAATMTAAGHHAEVVVDPEDERAIEMFMNKNPPARRTLADIIMEKLTEKQTEVETVMSEVSGFPMPQLDPRVLEVYRGVREVLSKYRSGKLPKAFKIIPALSNWEQILYVTEPEAWTAAAMYQATRIFASNLKERMAQRFYNLVLLPRVRDDVAEYKRLNFHLYMALKKALFKPGAWFKGILIPLCESGTCTLREAIIVGSIITKCSIPVLHSSAAMLKIAEMEYSGANSIFLRLLLDKKYALPYRVLDALVFHFLGFRTEKRELPVLWHQCLLTLVQRYKADLATDQKEALLELLRLQPHPQLSPEIRRELQSAVPRDVEDVPITVE

SEQ ID NO: 124 - DNA, 2177 bp, Homo sapiens
  misc_feature: Incyte ID No: 153825.1
gctgctgctccagccgccgccgctgctggcccgggctctgccgccggacgtccaccacctccatgccgagaggagggggccacagccctgggcatgcagccctgcccagtagcccggcacctgcccctgccacgcaggaagccccccggcctgccagcagcctcaggcctccccgctgtggcgtgcccgacccatctgatgggctgagtgcccgcaaccgacagaagaggttcgtgctttctggcgggcgctgggagaagacggacctcacctacaggatccttcggttcccatggcagttggtgcaggagcaggtgcggcagacgatggcagaggccctaaaggtatggagcgatgtgacgccactcacctttactgaggtgcacgagggccgtgctgacatcatgatcgacttcgccaggtactggcatggggacgacctgccgtttgatgggcctgggggcatcctgggcccatgccttcttccccaagactcaccgagaaggggatgtccacttcgactatgatgagacctggactatcggggatgaccagggcacagacctgctgcaggtggcagcccatgaatttggccacgtgctggggctgcagcacacaacagcagccaaggccctgatgtccgccttctacacctttcgctacccactgagtctcagcccagatgactgcaggggcgttcaacacctatatggccagccctggcccactgtcacctccaggaccccagccctgggcccccaggctgggatagacaccaatgagattgcaccgctggagccagacgccccgccagatgcctgtgaggcctcctttgacgcggtctccaccatccgaggcgagctctttttcttcaaagcgggctttgtgtggcgcctccgtgggggccagctgcagcccggctacccagcattggcctctcgccactggcagggactgcccagccctgtggacgctgccttcgaggatgcccagggccacatttggttcttccaaggtgctcagtactgggtgtacgacggtgaaaagccagtcctgggccccgcacccctcaccgagctgggcctggtgaggttcccggtccatgctgccttggtctggggtcccgagaagaacaagatctacttcttccgaggcagggactactggcgtttccaccccagcacccggcgtgtagacagtcccgtgccccgcagggccactgactggagaggggtgccctctgagatcgacgctgccttccaggatgctgatggctatgcctacttcctgcgcggccgcctctactggaagtttgaccctgtgaaggtgaaggctctggaaggcttcccccgtctcgtgggtcctgacttctttggctgtgccgagcctgccaacactttcctctgaccatggcttggatgccctcaggggtgctgacccctgccaggccacgaatatcaggctagagacccatggccatctttgtggctgtgggcaccaggcatgggactgagcccatgtctcctcagggggatggggtggggtacaaccaccatgacaactgccgggagggccacgcaggtcgtggtcacctgccagcgactgtctcagactgggcagggaggctttggcatgacttaagaggaagggcagtcttgggcccgctatgcaggtcctggcaaacctggctgccctgtctccatccctgtccctcagggtagcaccatggcaggactgggggaactggagtgtccttgctgtatccctgttgtgaggttccttccaggggctggcactgaagcaagggtgctggggccccatggccttcagccctggctgagcaactgggctgtagggcagggccacttcctgaggtcaggtcttggtaggtgcctgcatctgtctgccttctggctgacaatcctggaaatctgttctccagaatccaggccaaaaagttcacagtcaaatggggaggggtattcttcatgcaggagaccccaggccctggaggctgcaacatacctcaatcctgtcccaggccggatcctcctgaagcccttttcgcagcactgctatcctccaaagccattgtaaatgtgtgtacagtgtgtataaaccttcttcttcttttttttttttaaactgaggattgtcattaaacacagttgttttct

SEQ ID NO: 125 - DNA, 2230 bp, Homo sapiens
  misc_feature: Incyte ID No: 403484.2c
tttttttttttttttgggtggagattttcctttatttgattttattttggagaggaagggctagagcaaaaagatgatgccaacacaccgggcactagaatgacccctgcacatgcagaacacacggacactcaagctggattagtgactgagcaaatgtgccccgtggagagaatgtcaccagagctgcaaaagccccccgaccccagcttttattagttttaagacccccaaccacacccaccccaggtctccttgttttcagtaagcagacctcctagcaaactgggcttttactcctgtgggctcagtgccacatcccctcaaataaacatgcatcctctagagcaaaagggaaattgacaggatgctggaacgccgagagatgggatgctttatttttcattatccaccagcttgggagaaaggccaccttccatcgcaccagtgagaggcgggaaagagcgatcgggccctttcccgtctctcaggccttgtgcaacatggccctggctgctcactccagccctgcctgactttaaacaaacccagtcagtacccttccacctcttgccttgggaagaagacatttgagagctcacagatatagtgcaaccggttatccaaaccaacatgttctcttgctcagcttctgttctatccaaaggtctcatcctgctcccccaaggggatttctgatatctgaaaaccccaaacctgactccaggcctccccagcaacgtgtgagccccatggaatgtatttatttcattgcaacaacccctcacaacccggccttcctgcatttcccgagcggtcttgggtttttctcagcatctctcccggtggcgtgttgtggtgccctgacttggaggtgtgcagggtggcaggggaagtatcaggtgcctttgctttctgtcctctcctcgtcagccgtctgagcgttgctgacagcgcgaagctgcccctgggctgcaggcttcaccgacaggaccaagcgtttgcggaacgtctcacagagcacgatgtacacaaaggggttgaggcagctgttggcatagcccaagctgatggccgcattgtataagtagacaaaggtgagggtcgggcggctgatggacaactgggtcagctgtagcacatagtagggtgcccagcacacaaagaagaccagacagatggcgatggctgtgcgggtcaccctctttgtccgcagccggatgctgcgctgggaggtgggggccactgaggacgtcatgcgctgcaggatcctcacgtatgcggctgtgatgaccacaaaaggcagggcaaaggccaggaaaaactggtacagggtgaaccagtagaggtcagtgtctgggttgggcaggcgtatgccgcagcccactgcacctcctgggaaggggatgagtctggcatacagccacacaggggtgatgctgatgaaggagagggcccacaggaggcagatcaccagggtggccacagagggcttccggaacttcgtggaagagatggggtggacagtggccaggtagcggtcaatggccatggcggtcaggatgtaggtgctggtgaactgactattggcatccatggccgtgatgagggtgcacatggtctccccaaagtgccacaccccattgcccatgagctggtggatcatgaagggcatgcccaggagaaagaggagatctactaccgagaggttgatgatgaagatgtcggggacgttgttgcaccagtgcagcttggacttcttcacgaccgcgaagatgaccgtggagttcccgatgatgcccaggaggcagatggtgccgaacaccgaaggcatgatgatgttgatgtaggagatgctccccgtgcgaggaggtgatcctggggacagaaggagcaagcgttggctgtttgacatgggctttgctctgagaactgacatcctgctggcatgctcagcctccagcgacccaccgttcatctggaatcctctcccaccattctccctcccttcactgttgctaatcttgtcccttttcccttctccatgagtttcctggtgaatcctaccagagtgccctgagccatctgtcttggaaggacacaacatgcctgcctcctgcaggcaccagaggcaagaaccacagttgtctgcagagattactctgtgagccccgggcttcaccaggaaaactcgtcagcatagccagaaggacacaaaagtaagtgtctg

SEQ ID NO: 126 - DNA, 2143 bp, Homo sapiens
  misc_feature: Incyte ID No: 1459432CB1
ttatgtctggtcgactctgaattgggcttggaggcggcacggctgccaggctacggaggtagacccccttcccaactgcggggcttgcgctccgggacaaggtggcaggcgctggaggctgccgcagcctgcgtgggtggaggggagctcagctcggttgtggcagcatgcgaccggcactggctggatggacctggaagcctcgctgctgcccactggtcccaatgccagcaacacctctgatggccccgataacctcacttcggcaggatcacctcctcgcacggggagcatctcctacatcaacatcatcatgccttcggtgttcggcaccatctgcctcctgggcatcatcgggaactccacggtcatcttcgcggtcgtgaagaagtccaagctgcactggtgcaacaacgtccccgacatcttcatcatcaacctctcggtagtagatctcctctttctcctgggcatgcccttcatgatccaccagctcatgggcaatggggtgtggcactttggggagaccatgtgcaccctcatcacggccatggatgccaatagtcagttcaccagcacctacatcctgaccgccatggccattgaccgctacctggccactgtccaccccatctcttccacgaagttccggaagccctctgtggccaccctggtgatctgcctcctgtgggccctctccttcatcagcatcacccctgtgtggctgtatgccagactcatccccttcccaggaggtgcagtgggctgcggcatacgcctgcccaacccagacactgacctctactggttcaccctgtaccagtttttcctggcctttgccctgccttttgtggtcatcacagccgcatacgtgaggatcctgcagcgcatgacgtcctcagtggcccccacctcccagcgcagcatccggctgcggacaaagagggtgacccgcacagccatcgccatctgtctggtcttctttgtgtgctgggcaccctactatgtgctacagctgacccagttgtccatcagccgcccgacccccacctttgtctacttatacaatgcggccatcagcttgggctatgccaacagctgcctcaacccgtttgtgtacatcgtgctctgtgagacgttccgcaaacgcttggtcctgtcggtgaagcctgcagcccaggggcagcttcgcgctgtcagcaacgctcaggcggctgacgaggagaggacagaaagcaaaggcacctgatacttcccctgccaccctgcacacctccaagtcagggcaccacaacacgccaccgggagagatgctgagaaaaacccaagaccgctcgggaaatgcaggaaggccgggttgtgaggggttgttgcaatgaaataaatacattccatggggctcacacgttgctggggaggcctggagtcaggtttggggttttcagatatcagaaatccccttgggggagcaggatgagacctttggatagaacagaagctgagcaagagaacatgttggtttggataaccggttgcactatatctgtgagctctcaaatgtcttcttcccaaggcaagaggtggaagggtactgactgggtttgtttaaagtcaggcagggctggagtgagcagccagggccatgttgcacaaggcctgagagacgggaaagggcccgatcgctctttcccgcctctcactggtgcgatggaaggtggcctttctcccaagctggtggataatgaaaaataaagcatcccatctctcggcgttccagcatcctgtcaatttcccttttgctctagaggatgcatgtttatttgaggggatgtggcactgagcccacaggagtaaaagcccagtttgctaggaggtctgcttactgaaaacaaggagacctggggtgggtgtggttgggggtcttaaaactaataaaagctggggtcggggggcttttgcagctctggtgacattctctccacggggcacatttgctcagtcactaatccagcttgagtgtccgtgtgttctgcatgtgcaggggtcattctagtgcccggtgtgttggcatcatctttttgctctagcccttcctctccaaaataaaatcaaataaaggaaaatctccacccaaaaaaaaaaa

SEQ ID NO: 127 - protein, 353 aa, Homo sapiens
  misc_feature: Incyte ID No: 1459432CD1
MDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPTSQRSIRLRTKRVTRTAIAICLVFFVCWAPYYVLQLTQLSISRPTPTFVYLYNAAISLGYANSCLNPFVYIVLCETFRKRLVLSVKPAAQGQLRAVSNAQAADEERTESKGT

SEQ ID NO: 128 - DNA, 424 bp, Homo sapiens
  misc_feature: Incyte ID No: 1096583.1
tgtattaaccatgttaaagcatggttaaaactgagctcaggagtctgccaggaaaaggacagaccctgtgctttcatgaaagtgaagatctggctgaaccagttccacaaggttactgtatacatagcctgagtttaaacggcagggtttggctagttctaacttgctgaagccagtcagcaccctcacagagccagctaggtactgggcccaggggcttccagagagttcttcagagcttctcagaggcctgctagggttaggaggtccttaggcctctgagaagctctgaagaactctctggaagcccctgggcccagtacctagctggctctgtgagggtgctgactggcttcagcaagttagaactagccaaaccaggaccctgtccaatctttgacaattgggagctgccaagagtgaa

SEQ ID NO: 129 - DNA, 763 bp, Homo sapiens
  misc_feature: Incyte ID No: 516300CB1
caagaacatcatttaaatacacaatttttcattctctttttttgctaaatttcttcatactcaactttcagattctttaatctccagctcagcttcaacaattcaacgctgttctttctgaaaaagtacacatcgtgccttctctacttcgctcttggaacataatttctcatggcagtgtttaagaccactctgtggaggttaatttctgggaccttagggataatatgcctttcgttgatggctacgttgggaattttgttgaaaaattcttttactaaactgagtattgagccagcatttactccaggacccaacatagaactccagaaagactctgactgctgttcttgccaagaaaaatgggttgggtaccggtgcaactgttacttcatttccagtgaacagaaaacttggaacgaaagtcggcatctctgtgcttctcagaaatccagcctgcttcagcttcaaaacacagatgaactggattttatgagctccagtcaacaattttactggattggactctcttacagtgaggagcacaccgcctggttgtgggagaatggctctgcactctcccagtatctatttccatcatttgaaacttttaatacaaagaactgcatagcgtataatccaaatggaaatgctttagatgaatcctgtgaagataaaaatcgttatatctgtaagcaacagctcatttaaatgtttcttggggcagagaaggtggagagtaaagacccaacattactaacaa

SEQ ID NO: 130 - protein, 179 aa, Homo sapiens
  misc_feature: Incyte ID No: 516300CD1
MAVFKTTLWRLISGTLGIICLSLMATLGILLKNSFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 131 - DNA, 1449 bp, Homo sapiens
  misc_feature: Incyte ID No: 627856CB1
ggcccgctgcgctgagacactgaaggggtgtccgggagctgctgaaagcgtgtagacctcgcgacggtcccgcggtagacatcgatataagaagtaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaagggataacagtcgcttccctcctgccagagtttgtgatcctacgagatgagaaatggggtggaaacaaaacctacacagcttacgtggacctggaaaaggactttgctgctgaagttgtacatcctggagacctgaagaattctgttgaagtcgcactgaacaagttgctggatccaatccgggaaaagtttaatacccctgccctgaaaaaactggccagcgctgcctacccagatccctcaaagcagaagccaatggccaaaggccctgccaagaattcagaaccagaggaggtcatcccatcccggctggatatccgtgtggggaaaatcatcactgtggagaagcacccagatgcagacagcctgtatgtagagaagattgacgtgggggaagctgaaccacggactgtggtgagcggcctcgtacagttcgtgcccaaggaggaactgcaggacaggctggtagtggtgctgtgcaacctgaaaccccagaagatgagaggagtcgagtcccaaggcatgcttctgtgtgcttctatagaagggataaaccgccaggttgaacctctggaccctccggcaggctctgctcctggtgagcacgtgtttgtgaagggctatgaaaagggccaaccagatgaggagctcaagcccaagaagaaagtcttcgagaagttgcaggctgacttcaaaatttctgaggagtgcatcgcacagtggaagcaaaccaacttcatgaccaagctgggctccatttcctgtaaatcgctgaaaggggggaacattagctagccagcccagcatcttccccccttcttccaccactgagtcatctgctgtctcttcagtctgctccatccatcacccatttacccatctctcaggacacggaagcagcgggtttggactctttattcggtgcagaactcggcaaggggcagcttaccctccccagaacccagggatcatcctgtctggctgcagtgagagaccaacccctaacaagggctgggccacagcagggagtcca

SEQ ID NO: 132 - protein, 301 aa, Homo sapiens
  misc_feature: Incyte ID No: 627856CD1
MKPSPTGNCSLRVANLQPHPLPPGPAVRTFDASLLTEGITVASLLPEFVILRDEKWGGNKTYTAYVDLEKDFAAEVVHPGDLKNSVEVALNKLLDPIREKFNTPALKKLASAAYPDPSKQKPMAKGPAKNSEPEEVIPSRLDIRVGKIITVEKHPDADSLYVEKIDVGEAEPRTVVSGLVQFVPKEELQDRLVVVLCNLKPQKMRGVESQGMLLCASIEGINRQVEPLDPPAGSAPGEHVFVKGYEKGQPDEELKPKKKVFEKLQADFKISEECIAQWKQTNFMTKLGSISCKSLKGGNIS

SEQ ID NO: 133 - DNA, 3482 bp, Homo sapiens
  misc_feature: Incyte ID No: 1823159CB1
gggatagggaccgtcatttgcctagaagattttgactctggattgggcagcctgccccaatttgaatcctggacctaatattatctgtgtgactttaggcaagagtttccaggatggcttctgcatcaacttctaaatataattcacactccttggagaatgagtctattaagaggacgtctcgagatggagtcaatcgagatctcactgaggctgttcctcgacttccaggagaaacactaatcactgacaaagaagttatttacatatgtcctttcaatggccccattaagggaagagtttacatcacaaattatcgtctttatttaagaagtttggaaacggattcttctctaatacttgatgttcctctgggtgtgatctcgagaattgaaaaaatgggaggcgcgacaagtagaggagaaaattcctatggtctagatattacttgtaaagacatgagaaacctgaggttcgctttgaaacaggaaggccacagcagaagagatatgtttgagatcctcacgagatacgcgtttcccctggctcacagtctgccattatttgcatttttaaatgaagaaaagtttaacgtggatggatggacagtttacaatccagtggaagaatacaggaggcagggcttgcccaatcaccattggagaataacttttattaataagtgctatgagctctgtgacacttaccctgctcttttggtggttccgtatcgtgcctcagatgatgacctccggagagttgcaacttttaggtcccgaaatcgaattccagtgctgtcatggattcatccagaaaataagacggtcattgtgcgttgcagtcagcctcttgtcggtatgagtgggaaacgaaataaagatgatgagaaatatctcgatgttatcagggagactaataaacaaatttctaaactcaccatttatgatgcaagacccagcgtaaatgcagtggccaacaaggcaacaggaggaggatatgaaagtgatgatgcatatcataacgccgaacttttcttcttagacattcataatattcatgttatgcgggaatctttaaaaaaagtgaaggacattgtttatcctaatgtagaagaatctcattggttgtccagtttggagtctactcattggttagaacatatcaagctcgttttgacaggagccattcaagtagcagacaaagtttcttcagggaagagttcagtgcttgtgcattgcagtgacggatgggacaggactgctcagctgacatccttggccatgctgatgttggatagcttctataggagcattgaagggttcgaaatactggtacaaaaagaatggataagttttggacataaatttgcatctcgaataggtcatggtgataaaaaccacaccgatgctgaccgttctcctatttttctccagtttattgattgtgtgtggcaaatgtcaaaacagttccctacagcttttgaattcaatgaacaatttttgattataattttggatcatctgtatagttgccgatttggtactttcttattcaactgtgaatctgctcgagaaagacagaaggttacagaaaggactgtttctttatggtcactgataaacagtaataaagaaaaattcaaaaaccccttctatactaaagaaatcaatcgagttttatatccagttgccagtatgcgtcacttggaactctgggtgaattactacattagatggaaccccaggatcaagcaacaacagccgaatccagtggagcagcgttacatggagctcttagccttacgcgacgaatacataaagcggcttgaggaactgcagctcgccaactctgccaagctttctgatcccccaacttcaccttccagtccttcgcaaatgatgccccatgtgcaaactcacttctgaggggggaccctggcaccgcattagagctcgaaataaaggcgatagctgactttcatttggggcatttgtaaaaagtagattaaaatatttgcctccatgtagaacttgaactaacataatcttaaactcttgaatatgtgccttctagaatacatattacaagaaaactacagggtccacacggcaatcagaagaaaggagctgagatgaggttttggaaaaccctgacacctttaaaaagcagtttttgaaagacaaaatttagatttaatttacgtcttgagaaatactatatatacaatatatattttgtgggcttaattgaaacaacattattttaaaatcaaaggggatatatgtttgtggaatggattttcctgaagctgcttaacagttgctttggattctctaagatgaatccaaatgtgaaagatgcatgttactgccaaaaccaaattgagctcagcttcctaggcattacccaaaagcaaggtgtttaagtaattgccagcttttataccatcatgagtggtgacttaaggagaaatagctgtatagatgagtttttcattatttggaaatttaggggtagaaaatgttttcccctaattttccagagaagcctatttttatatttttaaaaaactgacagggcccagttaaatatgatttgcattttttaaatttgccagttttattttctaaattctttcatgagcttgcctaaaattcggaatggttttcgggttgtggcaaaccccaaagagagcactgtccaaggatgtcgggagcatcctgctgcttaggggaatgttttcgcaaatgttgctctagtcagtccagctcatctgccaaaatgtagggctaccgtcttggatgcatgagctattgctagagcatcatccttagaaatcagtgccccagatgtacatgtgttgagcgtattcttgaaagtattgtgtttatgcatttcaatttcaatggtgttggcttcccctccccaccccacgcgtgcataaaaactggttctacaaatttttacttgaagtaccaggccgtttgctttttcaggttgttttgttttatagtattaagtgaaattttaaatgcacagttctatttgctatctgaactaattcatttattaagtatatttgtaaaagctaaggctcgagttaaaacaatgaagtgttttacaatgatttgtaaaggactatttataactaatatggttttgttttcaatgaattaagaaagattaaatatatctttgtaaattattttatgtcatagtttaattggtctaccaagtaagacatctcaaatacagtagtataatgtatgaattttgtaagtataagaaattttattagacattctcttactttttgtaaatgctgtaaatatttcataaattaacaaagtgtcactccataaaaagaaagctaatactaatagcctaaaagattttgtgaaatttcatgaaaactttttaatggcaataatgactaaagacctgctgtaataaatgtattaactgaaacctaaaaaaaaaaa

SEQ ID NO: 134 - protein, 603 aa, Homo sapiens
  misc_feature: Incyte ID No: 1823159CD1
MASASTSKYNSHSLENESIKRTSRDGVNRDLTEAVPRLPGETLITDKEVIYICPFNGPIKGRVYITNYRLYLRSLETDSSLILDVPLGVISRIEKMGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFPTAFEFNEQFLIIILDHLYSCRFGTFLFNCESARERQKVTERTVSLWSLINSNKEKFKNPFYTKEINRVLYPVASMRHLELWVNYYIRWNPRIKQQQPNPVEQRYMELLALRDEYIKRLEELQLANSAKLSDPPTSPSSPSQMMPHVQTHF

SEQ ID NO: 135 - DNA, 1223 bp, Homo sapiens
  misc_feature: Incyte ID No: 232567.4
cgccgtctgcatggcactgcgctgggttgcccgcctttagaggagaggctctgcctggtgcccggacgtgggcgcggaggaaagcagccctcggagatttcgaaagatcgcggtggccgcgggcgtgctccggtctggcggattgcaaaacgggcccgtcgggctggctgcgcctggaggccgcgcgggctgggaactgctggctccgtcaagcgaagaacggccgctgccaggtcctgtacaagaccgaactgagcaaggaggagtgctgcagcaccggccggctgagcacctcgtggaccgaggaggacgtgaatgacaacacactcttcaagtggatgattttcaacgggggcgcccccaactgcatcccctgtaaagaaacgtgtgagaacgtggactgtggacctgggaaaaaatgccgaatgaacaagaagaacaaaccccgctgcgtctgcgccccggattgttccaacatcacctggaagggtccagtctggaagggctggatgggaaaacctaccgcaatgaatgtgcactcctaaaggcaagatgtaaagagcagccagaactggaagtccagtaccaaggcagatgtaaaaagacttgtcgggatgttttctgtccaggcagctccacatgtgtggtggaccagaccaataatgcctactgtgtgacctgtaatcggatttgcccagagcctgcttcctctgagcaatatctctgtgggaatgatggagtcacctactccagtgcctgccacctgagaaaggctacctgcctgctgggcagatctattggattagcctatgagggaaagtgtatcaaagcaaagtcctgtgaagatatccagtgcactggtgggaaaaaatgtttatgggatttcaaggttgggagaggccggtgttccctctgtgatgagctgtgccctgacagtaagtcggatgagcctgtctgtgccagtgacaatgccacttatgccagcgagtgtgccatgaaggaagctgcctgctcctcaggtgtgctactggaagtaaagcactccggatcttgcaactccatttcggaagacaccgaggaagaggaggaagatgaagaccaggactacagctttcctatatcttctattctagagtggtaaactctctataagtgttcagtgttgacatagcctttggctttttcacagtcacgacggtgtaaatcacgcacgacgcggcgta

SEQ ID NO: 136 - DNA, 648 bp, Homo sapiens
  misc_feature: Incyte ID No: 218419.1
  unsure 32, 34, 40, 58, 91, 110, 120, 123, 125, 144, 150: a, t, c, g, or other
ctcaaggggattaattcccattccttcctttnangtgganatccatcatctcagtgtngggaggcactgctgttaaattctctgccctctncaaacagccatctgtctgngaactccctnaantngctgctatccaggatgacngtgttnctgcagtctttgagtggttagagcgctgtaatgtctatgttaatagctgggaaatcgcagtagcagcaaccagaccactccaatggaacaatccaagttggggtaagtttgattgagcaaaaaagtcatgctgactgtgtgatgaagaggcagaactggtaacagtgacaggccctgcagtcagcagctgtggattttatgtgcagggcagactgatctggaaaatgggaagagctgactgccaataacaccttggggggaggtttgttcaagtgcatctccctactcctttgtatacctctggattgacatgcagaagcttaggaaataaaacacacttgtaacatcacagggtgcaagtaagtacatgtggatgcccagtgtagagagaagcgaaagctagttttcattgcaagaatccaaacagagtaacagggctttgtccactgtctccagtccatggttccctggtgttcctagagtcctattaaaaaaaaa

SEQ ID NO: 137 - DNA, 1197 bp, Homo sapiens
  misc_feature: Incyte ID No: 1630551CB1
gccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtaaaaaaaaaaa

SEQ ID NO: 138 - protein, 325 aa, Homo sapiens
  misc_feature: Incyte ID No: 1630551CD1
MAAAAASLRGVVLGPRGAGLPGARARGLLCSARPGQLPLRTPQAVALSSKSGLSRGRKVMLSALGMLAAGGAGLAVALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARHGGEDYVFSLLTGYCEPPTGVSLREGLYFNPYFPGQAIAMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 139 - DNA, 2100 bp, Homo sapiens
  misc_feature: Incyte ID No: 360961.19
atttttgatggttacttaaaattttggctactacatttttttcaggctttctgaaacctacatgtgaatcatcggaggatatttgctgaatgaattcagaataggcaacctaatccacttggaaagcactaggcgtaaagtagcttaaatcctgtaatttcagggtgatgctggtttgactggacggaaaatcattgtggacacttatggcggttggggtgctcatggaggaggtgccttttcaggaaaggattataccaaggtcgaccgttcagctgcttatgctgctcgttgggtggcaaaatcccttgttaaaggaggtctgtgccggagggttcttgttcaggtatacactctttatataacgaacgattaaaagtcatgtaagtgggagggtatttagtagtaatctacttaactacttgttttataccaacgtattatacaagtatatgggtctttgcaatcactgattcttacgacatttgaatccttttaggtctcttatgctattggagtttctcatccattatctatctccattttccattatggtacctctcagaagagtgagagagagctattagagattgtgaagaagaatttcgatctccgccctggggtcattgtcaggtaaagatggtaaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgttaagaaaatagagataaagtgggttgctcaaggtttgttgcaatgtaaaaaccatggtagggtgtgggcggcgggaccttggtaagtattgtgtgatctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggacttgtatattccagggatctggatctgaagaagccaatttatcagaggactgcagcctatggccactttggtagggacagcttcccatgggaagtgcccaaaaagcttaaatattgaaagtgttagccttttttccccagacttgttggcgtaggctacagagaagccttcaagctctgagggaaagggccctccttcctaaattttcctgtcctctttcagctcctgaccagttgcagtcactctagtcaatgacatgaattttagcttttgtgggggactgtaagttgggcttgctattctgtccctaggtgttttgttcaccattataatgaatttagtgagcataggtgatccatgtaactgcctagaaacaacactgtagtaaataatgctttgaaattgaacctttgtgccctatcacccaacgctccaaagtcataattgcattgactttccccaccagatgctgaaaatgtccttgtgatgtgcacgtaaagtacttgtagttccacttatagcctctgtctggcaatgccacagccctgtcagcatgaatttgtaatgtcttgagctctattatgaatgtgaagcctgttgctagtcaagtattgagggtgttgggtgtgtgtgtatatacttaaggctgaggaggtgaaggtgtgaaggaagactcctcaaatgggaatatattttaattcctggaacagttttgaactgctgccttagtgaagacttagttatttgagaaatttaaaattacggtgctccatggcttaggctaaccactctagagaatgttccagatttgatatttgagctttgtgctcttctacttaagggtgg

SEQ ID NO: 140 - DNA, 2115 bp, Homo sapiens
  misc_feature: Incyte ID No: 809809CB1
gaccgtgggaggttgttgtggctccgagggctgttcgaggagctgctgctgctgaggcggcggcaactgcattgaggtggtggcggcgctgccggccccgggccgctcggcctctcggctcgccttccagcctcgcctgagcccgccggggcccgcgccggccagcgcctgccctatgagtgtgtcactggttgttatccgattggagctcgcggaacactcgcctgtccccgccggcttcggcttcagcgccgcggccggggaaatgtctgatgaggagataaaaaagacgacactagcctcagctgtagcctgtttagaaggcaagtcaccaggagagaaagtagcgattatccatcagcatctcggccgtcgagaaatgacagatgtgatcattgagaccatgaagtccaacccagatgaactaaaaactacagtggaagaaaggaagtcttcagaagcctcccccactgcgcaaagaagtaaagatcacagtaaggaatgcataaacgctgccccagattctccgtccaaacagcttccagaccagatttcattcttcagtggaaatccatcagttgaaatagttcatggtattatgcacctatataagacaaataagatgacctccttaaaagaagatgtgcggcgcagtgccatgctgtgtattctcacagtccctgctgcaatgaccagtcatgaccttatgaagtttgttgccccatttaacgaagtaattgaacaaatgaaaattatcagagactctactcccaaccaatatatggtgctgataaagtttcgtgcacaggctgatgcggatagtttttatatgacatgcaatggccgccagttcaactcaatagaagatgacgtttgccagctagtgtatgtggaaagagctgaagtgctcaaatctgaagatggcgccagcctcccagtgatggacctgactgaactccccaagtgcacggtgtgtctggagcgcatggacgagtctgtgaatggcatcctcacaacgttatgtaaccacagcttccacagccagtgtctacagcgctgggacgataccacgtgtcctgtttgccggtactgtcaaacgcccgagccagtagaagaaaataagtgttttgagtgtggtgttcaggaaaatctttggatttgtttaatatgcggccacataggatgtggacggtatgtcagtcgacatgcttataagcactttgaggaaacgcagcacacgtatgccatgcagcttaccaaccatcgagtctgggactatgctggagataactatgttcatcgactggttgcaagtaaaacagatggaaaaatagtacagtatgaatgtgagggggatacttgccaggaagagaaaatagatgccttacagttagagtattcatatttactaacaagccagctggaatctcagcgaatctactgggaaaacaagatagttcggatagagaaggacacagcagaggaaattaacaacatgaagaccaagtttaaagaaacaattgagaagtgtgataatctagagcacaaactaaatgatctcctaaaagaaaagcagtctgtggaaagaaagtgcactcagctaaacacaaaagtggccaaactcaccaacgagctcaaagaggagcaggaaatgaacaagtgtttgcgagccaaccaagtcctcctgcagaacaagctaaaagaggaggagagggtgctgaaggagacctgtgaccaaaaagatctgcagatcaccgagatccaggagcagctgcgtgacgtcatgttctacctggagacacagcagaagatcaaccatctgcctgccgagacccggcaggaaatccaggagggacagatcaacatcgccatggcctcggcctcgagccctgcctcttcggggggcagtgggaagttgccctccaggaagggccgcagcaagaggggcaagtgaccttcagagcaacagacatccctgagactgttctccctgacactgtgagagtgtgctgggaccttcagctaaatgtgagggtgggccctaataagtacaagtgaggatcaagccacagttgtttggctctttcatttgctagtgtgtgatgtagtgaatgt

SEQ ID NO: 141 - protein, 592 aa, Homo sapiens
  misc_feature: Incyte ID No: 809809CD1
MSVSLVVIRLELAEHSPVPAGFGFSAAAGEMSDEEIKKTTLASAVACLEGKSPGEKVAIIHQHLGRREMTDVIIETMKSNPDELKTTVEERKSSEASPTAQRSKDHSKECINAAPDSPSKQLPDQISFFSGNPSVEIVHGIMHLYKTNKMTSLKEDVRRSAMLCILTVPAAMTSHDLMKFVAPFNEVIEQMKIIRDSTPNQYMVLIKFRAQADADSFYMTCNGRQFNSIEDDVCQLVYVERAEVLKSEDGASLPVMDLTELPKCTVCLERMDESVNGILTTLCNHSFHSQCLQRWDDTTCPVCRYCQTPEPVEENKCFECGVQENLWICLICGHIGCGRYVSRHAYKHFEETQHTYAMQLTNHRVWDYAGDNYVHRLVASKTDGKIVQYECEGDTCQEEKIDALQLEYSYLLTSQLESQRIYWENKIVRIEKDTAEEINNMKTKFKETIEKCDNLEHKLNDLLKEKQSVERKCTQLNTKVAKLTNELKEEQEMNKCLRANQVLLQNKLKEEERVLKETCDQKDLQITEIQEQLRDVMFYLETQQKINHLPAETRQEIQEGQINIAMASASSPASSGGSGKLPSRKGRSKRGK

SEQ ID NO: 142 - DNA, 2435 bp, Homo sapiens
  misc_feature: Incyte ID No: 2558815CB1
cggacgcgtgggcgcggagctgcgtccgccactcatgtttctccgagcaggcctggccgcgctctccccgcttcttcgcagtcttcggccctctcctgtcgccgccatgagcactggcaccttcgtcgtgtcgcagccgctcaattaccgcggcggggcccgcgtggagccggcggacgcctccggtaccgagaaagctttcgagccagcaaccggccgagtgatagctactttcacatgttcaggagaaaaggaagtaaatttggctgttcaaaatgcaaaggctgcttttaaaatatggagtcaaaaatctggcatggagcgttgccgaatccttttggaggctgccaggataataagggaacgggaggatgaaattgctactatggagtgcatcaacaatggcaagtccatctttgaggcccgcttggacatcgacatttcctggcagtgcctggagtattatgcgggcttggctgcatccatggctggtgaacacatccagctcccaggtggatcgtttggttataccagaagagaaccacttggggtatgtgtgggaataggagcatggaactacccctttcagattgcctcttggaagtcggctccagcattagcctgtggtaatgccatggtctttaaaccttctccctttacacctgtttctgcattgctactggctgaaatctacagtgaggctggtgtacctcctgggctcttcaatgtggtgcagggaggggctgccacaggccagtttctgtgtcagcatcccgatgtggccaaagtctccttcactggaagtgtgcccactggcatgaagatcatggagatgtcagctaaaggaatcaaacctgttaccttggaacttggaggcaaatctccactcatcatcttctcagactgtgatatgaacaatgctgtaaagggggcgctgatggccaacttcctcacacaaggccaggtttgctgtaatggcacaagagtatttgtgcagaaagaaattcttgataaatttacagaggaagtggtgaaacagacccaaaggattaaaattggagatccccttctggaagatacaaggatgggtccactcatcaaccgaccacacctggagcgagtccttgggtttgtcaaagtggcaaaggagcagggtgctaaagtgttatgtggtggagatatatatgtacctgaagatcccaaattaaaggatggatattacatgagaccttgtgtattaactaattgcagagacgacatgacctgtgtgaaggaagagatctttgggcctgttatgtccattttatcatttgacactgaagctgaggttctagaaagagccaatgataccacttttggactagcagctggcgtctttaccagggacatccaacgggctcatagagtggtagctgagcttcaggctgggacgtgcttcattaacaactataacgtcagcccagtggagttgccctttggtggatataagaagtcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagctatatccccttgtcattccattgagaaagctgacaactgggatagggaggggattcgataatagatggggtcaaattctgtgtgaatgtgaacttgcctagtaagcactttgtctctgttcactactgcgatagaggaaatctatctccctatcttgggtccttgaactacagcctgctgtcttacaccagtggagctaccctttaaatgtacaaattatttgtatgctaatgtaatatggtgaaattaaaataaatcacactgttaattgttaaaaaaaaaa

SEQ ID NO: 143 - protein, 518 aa, Homo sapiens
  misc_feature: Incyte ID No: 2558815CD1
MFLRAGLAALSPLLRSLRPSPVAAMSTGTFVVSQPLNYRGGARVEPADASGTEKAFEPATGRVIATFTCSGEKEVNLAVQNAKAAFKIWSQKSGMERCRILLEAARIIREREDEIATMECINNGKSIFEARLDIDISWQCLEYYAGLAASMAGEHIQLPGGSFGYTRREPLGVCVGIGAWNYPFQIASWKSAPALACGNAMVFKPSPFTPVSALLLAEIYSEAGVPPGLFNVVQGGAATGQFLCQHPDVAKVSFTGSVPTGMKIMEMSAKGIKPVTLELGGKSPLIIFSDCDMNNAVKGALMANFLTQGQVCCNGTRVFVQKEILDKFTEEVVKQTQRIKIGDPLLEDTRMGPLINRPHLERVLGFVKVAKEQGAKVLCGGDIYVPEDPKLKDGYYMRPCVLTNCRDDMTCVKEEIFGPVMSILSFDTEAEVLERANDTTFGLAAGVFTRDIQRAHRVVAELQAGTCFINNYNVSPVELPFGGYKKSGFGRENGRVTIEYYSQLKTVCVEMGDVESAF

SEQ ID NO: 144 - DNA, 2412 bp, Homo sapiens
  misc_feature: Incyte ID No: 242010.16
gcctgaggagctgctgcgacagtccactacctttttcgagagtgactcccgttgtcccaaggcttcccagagcgaacctgtggcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaagacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtgaaaaacaaaaaaaagg

SEQ ID NO: 145 - DNA, 2458 bp, Homo sapiens
  misc_feature: Incyte ID No: 1678695CB1
gcctgaggagctgctgcgagggtccgcttcgtctttcgagagtgactcccgcggtcccaaggctttccagagcgaacctgtgcggctgcaggcaccggcgtgttgagtttccggcgttccgaaggactgagctcttgtcgcggatcccgtccgccgtttccagcccccagtctcagagcggagcccacagagcagggcaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcgcctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcgactgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttgtccttaagaagttgcccttaaattgaacttttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgttttttttttttttttttttttttttgcttggcgaaaacactacaaaggctggga

SEQ ID NO: 146 - protein, 641 aa, Homo sapiens
  misc_feature: Incyte ID No: 1678695CD1
MAKAAAIGIDLGTTYSCVGVFQHGKVEIIANDQGNRTTPSYVAFTDTERLIGDAAKNQVALNPQNTVFDAKRLIGRKFGDPVVQSDMKHWPFQVINDGDKPKVQVSYKGETKAFYPEEISSMVLTKMKEIAEAYLGYPVTNAVITVPAYFNDSQRQATKDAGVIAGLNVLRIINEPTAAAIAYGLDRTGKGERNVLIFDLGGGTFDVSILTIDDGIFEVKATAGDTHLGGEDFDNRLVNHFVEEFKRKHKKDISQNKRAVRRLRTACERAKRTLSSSTQASLEIDSLFEGIDFYTSITRARFEELCSDLFRSTLEPVEKALRDAKLDKAQIHDLVLVGGSTRIPKVQKLLQDFFNGRDLNKSINPDEAVAYGAAVQAAILMGDKSENVQDLLLLDVAPLSLGLETAGGVMTALIKRNSTIPTKQTQIFTTYSDNQPGVLIQVYEGERAMTKDNNLLGRFELSGIPPAPRGVPQIEVTFDIDANGILNVTATDKSTGKANKITITNDKGRLSKEEIERMVQEAEKYKAEDEVQRERVSAKNALESYAFNMKSAVEDEGLKGKISEADKKKVLDKCQEVISWLDANTLAEKDEFEHKRKELEQVCNPIISGLYQGAGGPGPGGFGAQGPKGGSGSGPTIEEVD

SEQ ID NO: 147 - DNA, 4035 bp, Homo sapiens
  misc_feature: Incyte ID No: 988653.1
  unsure 2626, 3304-3502: a, t, c, g, or other
gagatcccagcgctgcagaacttggggagccgccgccgccatccgccgccgcagccagcttcctgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaccacaaaaggaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttcttttnttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattgggtatgtgtttcctgggttaggggaaggactctgccctattgagggctgtgaggttttctgaagacttggcctttagagatacaaggatcctccagccagagtcaggcccactgtgtgaaactggagttcgttatttatgaggactgagtatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttgataatgggcctgttcctcttcagtctgttgggctgaagctttaccttggttagctaaagccaagaaaggcaagagttagggctgggacatgtgtggccaaaggcagtgttactctcctggcatcaaatgttgggccagtcccgtcccccacctctactcagggttggaaaacccatgatcttgggaatccctgccatgtgcagttagaggaggtaagaagtaggcacaaggcctttaggggaacagtaacaatgctggggccgactcagcctctccctcccattccccaggtccccagcaacttgagggcatcaaagaagcctagacgaggtaaaggccagttctcaagccaagaatccttccaggaagaaattcttattacttgccagctggaactgccatccttggcagcttcgtgggacaaaggatagagtgggcagaagcctggcctggtgtctaaagttcccatccgggccaaatctgttcccattgtgtaggaggcctgaggttctaggttcttttgggcc

SEQ ID NO: 148 - DNA, 3229 bp, Homo sapiens
  misc_feature: Incyte ID No: 1250434CB1
acaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaataggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaattgttaccaccgtgttttcacattgtacatattataatggcttgccggcgtacgtggtagccccatttgcccattttttgtcttgaagga

SEQ ID NO: 149 - protein, 827 aa, Homo sapiens
  misc_feature: Incyte ID No: 1250434CD1
MEGAGGANDKKNRISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 150 - DNA, 1790 bp, Homo sapiens
  misc_feature: Incyte ID No: 236196.3
  unsure 159-272: a, t, c, g, or other
agattattaaaaatttgagttacaaaaagactacaaagaagactacacataatttaagcccttttaaaaagtttcacttagatttaaaggtcaaggcatttgaacacttcagtaaaacatagtcattttttataatgttttaatttgccatgaacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaaa

SEQ ID NO: 151 - DNA, 584 bp, Homo sapiens
  misc_feature: Incyte ID No: 442308.1
gtccggaggaagagaacgaggggcccgagccaaccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagcc

SEQ ID NO: 152 - DNA, 597 bp, Homo sapiens
  misc_feature: Incyte ID No: 060957.1
  unsure 77, 97, 371: a, t, c, g, or other
ggcgggggtcgtcccggccgcccccaccgtcattaaaggcccctctcaaacactcgaggaggttttcggagcgcgancggcccgacagcatgaaaancacagggcgattgaaatgcgagcattgggacgcacggagccgccgcggcgcggaactcgctcttgaggtcaagtgacggacggattgtatgcttcttcataataatattaattaaacaatttgcatgctaataaggtaacaattatcagggcctctgttgaaagattcgggttattacaacacgccaatctgaaggccaggggtcagagagtgagaggcgagcgaaatttcaactcaaattaacattctgtcagctccagaaaatgggataaanaaagtcgaattaattcattataataaagagagatgggcgagggagctcggccggcgcgcgcccctcctctgccctccccccgggccgaatagattacagctctgtattcagaaacaccgccgcgcgcattcctcctcgcgaacccaacagaagaccaggcgcttgtggctgctggcgaaatcgagtcggatggacggagtttacatttagtatttatagagacaag

SEQ ID NO: 153 - DNA, 1899 bp, Homo sapiens
  misc_feature: Incyte ID No: 014284CB1
atttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataaaaaa

SEQ ID NO: 154 - protein, 463 aa, Homo sapiens
  misc_feature: Incyte ID No: 014284CD1
MGAGPSLLLAALLLLLSGDGAVRCDTPANCTYLDLLGTWVFQVGSSGSQRDVNCSVMGPQEKKVVVYLQKLDTAYDDLGNSGHFTIIYNQGFEIVLNDYKWFAFFKYKEEGSKVTTYCNETMTGWVHDVLGRNWACFTGKKVGTASENVYVNTAHLKNSQEKYSNRLYKYDHNFVKAINAIQKSWTATTYMEYETLTLGDMIRRSGGHSRKIPRPKPAPLTAEIQQKILHLPTSWDWRNVHGINFVSPVRNQASCGSCYSFASMGMLEARIRILTNNSQTPILSPQEVVSCSQYAQGCEGGFPYLIAGKYAQDFGLVEEACFPYTGTDSPCKMKEDCFRYYSSEYHYVGGFYGGCNEALMKLELVHHGPMAVAFEVYDDFLHYKKGIYHHTGLRDPFNPFELTNHAVLLVGYGTDSASGMDYWIVKNSWGTGWGENGYFRIRRGTDECAIESIAVAATPIPKL

SEQ ID NO: 155 - DNA, 898 bp, Homo sapiens
  misc_feature: Incyte ID No: 1095192.1
cacaaatctccttaaggtcagtgcctacaataagacagtgaccccttgtcagcaaactgtgactctgtgtaaaggggagatgaccttgacaggaggttactgttctcactaccagctgacactgctgaagataagatgcacaatggctagtcagactgtagggaccagtttcaaggggtgcaaacctgtgattttggggttgtttaacatgaaacactttagtgtagtaattgtatccactgtttgcatttcaactgccacatttgtcacatttttatggaatctgttagtggattcatctttttgttaatccatgtgtttattatatgtgactatttttgtaaacgaagtttctgttgagaaataggctaaggacctctataacaggtatgccacctggggggtatggcaaccacatggccctcccagctacacaaagtcgtggtttgcatgagggcatgctgcacttagagatcatgcatgagaaaaagtcacaagaaaaacaaattcttaaatttcaccatatttctgggaggggtaattgggtgataagtggaggtgctttgttgatcttgttttgcgaaatccagcccctagaccaagtagattgtttgtgggtaggccagtaaatcttagcaggtgcaaacttcattcaaatgtttggagtcataaatgttatgtttcttttagttgtattaaaaaaaaaacctgaatagtgaatatggcccctcaccctccaccgccagaagactgaatggaccaaaattactctttataaatttctgctttttcctgcacttggtttagccatcttcggctctcagcaaggttgacactgtatatgttaatgaaatgctatttattatgtaaatagtcattttaccctgtggtgcacgtt

SEQ ID NO: 156 - DNA, 717 bp, Homo sapiens
  misc_feature: Incyte ID No: 233003.20
  unsure 564, 622, 669, 677, 700: a, t, c, g, or other
tttcttcaagagctggtagatcgggataattccaaatttgaggagtggtgtattgaaatggctgagatacgtaagcaaagtgtggataaaggaaaagcaaaacacgaagagttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcgatggattttgggtggggaagtcctccttgcggagttggcgccagctagctcttgaacagctggatgagcaagatggtgatgcagaacaaagcaacggaaagntgaacggtagcaccttaaataaagatgaatcaaaggaagaaagaaaagaagaggaggnattaaattttaatgaagatattctgtgtccacatggtgagttatgcntatctganaatgaaagaaggcttgtttctanagaggcttggagcaaac

SEQ ID NO: 157 - DNA, 2510 bp, Homo sapiens
  misc_feature: Incyte ID No: 1911808CB1
ccacttaaaagttctcggaaaaaaaaaaagaagaccatctgaattggtgggaattaaccctttcaaatgccatcagtacatctggatgaagaattacagtgttaacagcgtcttctgaagtgtgctcatattcgctgagttttatttcagtttggcttctcatttgaattttcagatgtatatcacatatatgtgaaaagtactgacaaaaataatttatgaaataaacacagtagggcatgaggttgtgttatttgtgaggcagcaatggagcatgacttgtagtcaacaaacatgggtgtcctgatcaaagctctgctgtgctattcggcaagactctatgtggatgcctcttgtagaatgtggttaataataccagccgatctcatagggcactgtgcagactcagcattatggtgcacagctccttgaactcataggagtggcacttaactggagctttgtgtcgtactcatcaaacatcttcccccagacaatgattcttctgattctgctaactctggacagagtttgcattgtcttttgagaaaaatgaatttatcacttagtcaaaaaactgtaaaaatacataggctctttccgatgcttgctttctcagagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaagaaaatgaagccttacataagatgattgcaaacgagcaaaagacttctctcccaaatttgttccaggataaaaacagaccgtgtctcagtaactggccagaggatacggatgtcctctacatcgtgtctcagttctttgtagaagagtggcggaaatttgttagaaagcctacaagatgcagccctgtgtcatcagttgggaacagtgctcttttgtgtccccacgggggcctcatgtttacatttgcttccatgaccaaagaagattctaaacttatagctctcatatggcccagtgagtggcaaatgatacaaaagctctttgttgtggatcatgtaattaaaatcacgagaattgaagtgggagatgtaaacccttcagaaacacagtatatttctgagcccaaactctgtccagaatgcagagaaggcttattgtgtcagcagcagagggacctgcgtgaatacactcaagccaccatctatgtccataaagttgtggataataaaaaggtgatgaaggattcggctccggaactgaatgtgagtagttctgaaacagaggaggacaaggaagaagctaaaccagatggagaaaaagatccagattttaatcaaagcaatggtggaacaaagcggcaaaagatatcccatcaaaattatatagcctatcaaaagcaagttattcgccgaagtatgcgacatagaaaagttcgtggtgagaaagcacttctcgtttctgctaatcagacgttaaaagaattgaaaattcagatcatgcatgcattttcagttgctccttttgaccagaatttgtcaattgatggaaagattttaagtgatgactgtgccaccctaggcacccttggcgtcattcctgaatctgtcattttattgaaggctgatgaaccaattgcagattatgctgcaatggatgatgtcatgcaagtttgtatgccagaagaagggtttaaaggtactggtcttcttggacattaatctttgaatacttgctgactgctaagaaatgaccagaggggaagaggagtttgacatgttagggcattaaagcaaaggtggatttaagaattaaaccattacatgccccttccaaaaggcagaaatccattcaaacgtgactgtcccaaatgccttatgtcaaataaagcagattgcactgatggacatcagacttgaaggaaatgtttccattttatatttaagggggggag

SEQ ID NO: 158 - protein, 254 aa, Homo sapiens
  misc_feature: Incyte ID No: 1911808CD1
MFTFASMTKEDSKLIALIWPSEWQMIQKLFVVDHVIKITRIEVGDVNPSETQYISEPKLCPECREGLLCQQQRDLREYTQATIYVHKVVDNKKVMKDSAPELNVSSSETEEDKEEAKPDGEKDPDFNQSNGGTKRQKISHQNYIAYQKQVIRRSMRHRKVRGEKALLVSANQTLKELKIQIMHAFSVAPFDQNLSIDGKILSDDCATLGTLGVIPESVILLKADEPIADYAAMDDVMQVCMPEEGFKGTGLLGH

SEQ ID NO: 159 - DNA, 4266 bp, Homo sapiens
  misc_feature: Incyte ID No: 978276.8
  unsure 1545, 1608, 1611, 1615, 1619, 3504-3528: a, t, c, g, or other
ctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccggggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgngagttatggaatttctagtccataactgaagtctttatgataacgggtttttaaaaatgaatntgnctancttnagttcaaaacatgtaaatttggttcccagagtgggccaatctctctggtcttggtatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacggacacctgcatcatcgaaggnnnnnnnnnnnnnnnnnnnnnnnnntgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttcaa

SEQ ID NO: 160 - DNA, 1056 bp, Homo sapiens
  misc_feature: Incyte ID No: 405844.21
tgagcccagcgctgactgcgccgcggagaaagccagtgggaacccagacccataggagacccgcgtccccgctcggcctggccaggccccgcgctatggagttcctctgggcccctctcttgggtctgtgctgcagtctgggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctctcacagtcctcaggcccatgtcaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactg

SEQ ID NO: 161 - DNA, 1557 bp, Homo sapiens
  misc_feature: Incyte ID No: 405844.22
ggcgaaggggccagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgtcaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatgcacctagcagcctcaaaacgggtcaatattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgggaaaaaaaaaaaaaacggccgctcgcgatcagaac

SEQ ID NO: 162 - DNA, 2256 bp, Homo sapiens
  misc_feature: Incyte ID No: 2705515CB1
cacgcgtccgcccacgcgtccggctgatgcaatgaccagctaatggctcgattctcaagagggtttcattggtctcaacctggccccccaggcaacccacccctgattggacagtctcatcaagaaggttggtcaagagctcaagtgtttctgagaatctgggtgatttataagaaacccttagctgaatgcagggtggggagaacgaaagacaaaagcatcttttttcagaagggaaactgaaagaaagaggggaagagtattaaagaccatttctggctgggcagggcactctcagcagctcaactgcccagcgtgaccagtggccacctctgcagtgtcttccacaacctggtcttgactcgtctgctgaacaaatcctctgacctcaggccggctgtgaacgtagttcctgagagatagcaaacatgcccaacagtgagcccgcatctctgctggagctgttcaacagcatcgccacacaaggggagctcgtaaggtccctcaaagcgggaaatgcgtcaaaggatgaaattgattctgcagtaaagatgttggtgtcattaaaaatgagctacaaagctgccgcgggggaggattacaaggctgactgtcctccagggaacccagcacctaccagtaatcatggcccagatgccacagaagctgaagaggattttgtggacccatggacagtacagacaagcagtgcaaaaggcatagactacgataagctcattgttcggtttggaagtagtaaaattgacaaagagctaataaaccgaatagagagagccaccggccaaagaccacaccacttcctgcgcagaggcatcttcttctcacacagagatatgaatcaggttcttgatgcctatgaaaataagaagccattttatctgtacacgggccggggcccctcttctgaagcaatgcatgtaggtcacctcattccatttattttcacaaagtggctccaggatgtatttaacgtgcccttggtcatccagatgacggatgacgagaagtatctgtggaaggacctgaccctggaccaggcctatagctatgctgtggagaatgccaaggacatcatcgcctgtggctttgacatcaacaagactttcatattctctgacctggactacatggggatgagctcaggtttctacaaaaatgtggtgaagattcaaaagcatgttaccttcaaccaagtgaaaggcattttcggcttcactgacagcgactgcattgggaagatcagttttcctgccatccaggctgctccctccttcagcaactcattcccacagatcttccgagacaggacggatatccagtgccttatcccatgtgccattgaccaggatccttactttagaatgacaagggacgtcgcccccaggatcggctatcctaaaccagccctgttgcactccaccttcttcccagccctgcagggcgcccagaccaaaatgagtgccagcgaccccaactcctccatcttcctcaccgacacggccaagcagatcaaaaccaaggtcaataagcatgcgttttctggagggagagacaccatcgaggagcacaggcagtttgggggcaactgtgatgtggacgtgtctttcatgtacctgaccttcttcctcgaggacgacgacaagctcgagcagatcaggaaggattacaccagcggagccatgctcaccggtgagctcaagaaggcactcatagaggttctgcagcccttgatcgcagagcaccaggcccggcgcaaggaggtcacggatgagatagtgaaagagttcatgactccccggaagctgtccttcgactttcagtagcactcgttttacatatgcttataaaagaagtgatgtatcagtaatgtatcaataatcccagcccagtcaaagcaccgccacctgtaggcttctgtctcatggtaattactgggcctggcctctgtaagcctgtgtatgttatcaatactgtttcttcctgtgagttccattatttctatctcttatgggcaaagcattgtgggtaattggtgctggctaacattgcatggtcggatagagaagtccagctgtgagtctctccccaaagcagccccacagtggagcctttggctggaagtccatgggccaccctgttcttgtccatggaggactccgagggttccaagtatactcttaagacccactctgtttaaaaatatatattctatgtatgcgtaaaaaaaaaaaaaaa

SEQ ID NO: 163 - protein, 471 aa, Homo sapiens
  misc_feature: Incyte ID No: 2705515CD1
MPNSEPASLLELFNSIATQGELVRSLKAGNASKDEIDSAVKMLVSLKMSYKAAAGEDYKADCPPGNPAPTSNHGPDATEAEEDFVDPWTVQTSSAKGIDYDKLIVRFGSSKIDKELINRIERATGQRPHHFLRRGIFFSHRDMNQVLDAYENKKPFYLYTGRGPSSEAMHVGHLIPFIFTKWLQDVFNVPLVIQMTDDEKYLWKDLTLDQAYSYAVENAKDIIACGFDINKTFIFSDLDYMGMSSGFYKNVVKIQKHVTFNQVKGIFGFTDSDCIGKISFPAIQAAPSFSNSFPQIFRDRTDIQCLIPCAIDQDPYFRMTRDVAPRIGYPKPALLHSTFFPALQGAQTKMSASDPNSSIFLTDTAKQIKTKVNKHAFSGGRDTIEEHRQFGGNCDVDVSFMYLTFFLEDDDKLEQIRKDYTSGAMLTGELKKALIEVLQPLIAEHQARRKEVTDEIVKEFMTPRKLSFDFQ

SEQ ID NO: 164 - DNA, 3290 bp, Homo sapiens
  misc_feature: Incyte ID No: 2023119CB1
cggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacggtgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctactgatggccggctcagtcagtgctatgtttggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattgtgatgtcttggttcgtgtccccactgctttctggaattatgtctggaattttattcttcctggttcgtgcattcatcctccataaggcagatccagttcctaatggtttgcgagctttgccagttttctatgcctgcacagttggaataaacctcttttccatcatgtatactggagcaccgttgctgggctttgacaaacttcctctgtggggtaccatcctcatctcggtgggatgtgcagttttctgtgcccttatcgtctggttctttgtatgtcccaggatgaagagaaaaattgaacgagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctagtggcttcagtattgaactggcatctgccctcactgtggtgattgcatcaaatattggccttcccatcagtacaacacattgtaaagtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagtttttagaaaaaaaaaaa

SEQ ID NO: 165 - protein, 679 aa, Homo sapiens
  misc_feature: Incyte ID No: 2023119CD1
MATVITSTTAATAASGPLVDYLWMLILGFIIAFVLAFSVGANDVANSFGTAVGSGVVTLKQACILASIFETVGSVLLGAKVSETIRKGLIDVEMYNSTQGLLMAGSVSAMFGSAVWQLVASFLKLPISGTHCIVGATIGFSLVAKGQEGVKWSELIKIVMSWFVSPLLSGIMSGILFFLVRAFILHKADPVPNGLRALPVFYACTVGINLFSIMYTGAPLLGFDKLPLWGTILISVGCAVFCALIVWFFVCPRMKRKIEREIKCSPSESPLMEKKNSLKEDHEETKLSVGDIENKHPVSEVGPATVPLQAVVEERTVSFKLGDLEEAPERERLPSVDLKEETSIDSTVNGAVQLPNGNLVQFSQAVSNQINSSGHYQYHTVHKDSGLYKELLHKLHLAKVGDCMGDSGDKPLRRNNSYTSYTMAICGMPLDSFRAKEGEQKGEEMEKLTWPNADSKKRIRMDSYTSYCNAVSDLHSASEIDMSVKAEMGLGDRKGSNGSLEEWYDQDKPEVSLLFQFLQILTACFGSFAHGGNDVSNAIGPLVALYLVYDTGDVSSKVATPIWLLLYGGVGICVGLWVWGRRVIQTMGKDLTPITPSSGFSIELASALTVVIASNIGLPISTTHCKVGSVVSVGWLRSKKAVDWRLFRNIFMAWFVTVPISGVISAAIMAIFRYVILRM

SEQ ID NO: 166 - DNA, 5163 bp, Homo sapiens
  misc_feature: Incyte ID No: 1000084.27
  unsure 4653-4674: a, t, c, g, or other
aaggcccttcggggccggccaccctttcactacttctcccccggactccttggtagtctgttagtgggagatccttgttgccgtcccttcgcctccttcaccgccgcagaccccttcaagttctagtcatgcgtgagtgcatctccatccacgttggccagggctggtgtccagattgggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattgatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccatgaacagctttctgtagcagagatcaccaatgcttgctttgagccagccaaccagatggtgaaatgtgaccctcgccatggtaaatacatggcttgctgcctgttgtaccgtggtgacgtggttcccaaagatgtcaatgctgccattgccaccatcaaaaccaagcgcagcatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagatatggctgcccttgagaaggattatgaggaggttggtgtggattctgttgaaggagagggtgaggaagaaggagaggaatactaattatccattccttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaactttgtcgttgtttaaaaataaatatgtactacggaatatctcgaaaaactgcactagagacaaagacgtgatgttaatatcttttccccacaattattacggataaacagtagcaccaataaataaatgataacaaatattaaaattaaaaaaggagagagatttagtatgtagaattctctattttttcttgttttgtttttacatataaaaaacagaatagcaatgtctattttatcagaatcacatatatacataaacatatgtatatatatatacacacaaatacaagttgccaaatatatatatagtatgtagatgtatattgaaaccttatttcaaaggaatgtgtgctggggagccaggggatcggggagggcagagctgagtgttagcaaaattaaatatctgttcaagataagctagtgactgtcaccgatcagggagagagagattggaaacatgaattttatatacaaaaaccggtacaaataagagagcaagagagagcaaaagatacatctcataaatagttgaaattaaatattaaccaagaatactgaaaaaaaaaccctactctttaattaaattaactgttttaatttctaattaaaaagggatattaaataagtaccgtatataaaacactttctcttttctctgcctccacaatgggcacgtggatcctgccctgtctctctggtccttcccttcccttcccgaggcacagagagacagggcaggatccacgtgcccattgtggagggaagggaaggaccaggggatggaggaaggtcaaccactcacacacacacaaccaggtctcctggggggacagaactagtggtttcaatggtgtgaggacataggtccttttaggctgcatcccaggaaggggagcaggaagaggatgagggcgagtcccaggaaggggagctgtcatgggctgcttcttccaacaatgtgtctcttctcttcgccgggacatctgccagtggtctcctgggcaactcagaagcaggtgagagtaagcgaaggccgcccaggctcctgaatcttccaggcagtgcccctgggggcgagatgcgcgtgcagcatgtggagggaatccccaaagcacagcaatgtcctgaagctccccaaactcctggtcagagccggtgtcctcatccctgtacctgtgatctgtctttctgtccgtctgacctggggtagagaggctcagcgccagggctgggtttgtcggtgttcccaaaactgggtcatatttgcccccatgccctggccttgcacattcctgggcaggggagaggaccctggccccaccaagtgggacaaaaaaaagatcatgccagagtctctcatctcctcctcttccctgtcaggatctgagtgggaacattcccctcccaactcaagtccacagcagtcaaatacatccagtgaagacaccaataacattagcactgttaatttaaaaaaagaatatatatattttatatatataaaatagagatatttatttttatatatatataatatatatatatataaatgtatgtatgtgggtgggtgtgtctacaggaatcccagaaataaaactctctaatcttccgggctcggtgatttagcagcaagaaaaataaaatggcgaatccaattccaagagggaccgtgctgggtcacccgcccgggaatgcttccgccggagtctcgccctccggacccaaagtgctctgcgcagagtctcctcttccttcatttcaggtttctggattaaggactgttctgtcgatggtgatggtgtggtggcggcagcgtggtttctgtatcgatcgttctgtatcagtctttcctggtgagagatctggttcccgaaaccctgagggaggctccttcctcctgcccggctcaccgcctcggcttgtcacatctgcaagtacgttcgtttaactcaagctgcctcgccttgcaacgcgagtctgtgtttttgcaggaacatttacacgtctgcggatcttgtacaaacaaatgctttctccgctctgagcaaggcccacagggattttcttgtcttgctctatctttctttggtctgcattcacatttgttgtgctgtaggaagctcatctctcctatgtgctggccttggtgaggtttgatccgcataatctgcatggtgatgttggactcctcagtgggcacacactccaggccctcgtcattgcagcagcccccgcatcgcatcaggggcacacaggatggcttgaagatgtactcgatctcatcagggtactcctggaagatgtccaccagggtctcgattggatggcagtagctgcgctgatagacatccatgaacttcaccacttcgtgatgattctgccctcctccttctgccatgggtgcagcctgggaccacttggcatggtggaggtagagcagcaaggcaaggctccaatgcacccaagacagcagaaagttcatggtttcggaggcccgaccggggccggcgcggctcgcgctccctctccggctcgggctgtggggcggcccgctctcctcggcgcctcggcgagctactcttcctccccggcccgaggcccgggccagggcctggggagcgcgcgcggctggagcactgtctgcgcacaccgccgcctcacccgtccatgagcccggcttccgagcgccgagtcgccactgcggccccctctcctcttccttctcttcttcctcctccccctcctccggctgcggctcctcccggcccgagctagcacttctcgcggctccgctcggctcggcttcccccgcgcggaccacggctcctccgaagcgagaacagcccagaagttggacgaaaagtttcagtgcgacgccgcgagccccgaccccctccaccccgcctccgggcgcgggctccggcccctgcccgcggctcgccgccgcgtccactgtccgccgccggccggggaggaggtggtagctggggctgggggcggnnnnnnnnnnnnnnnnnnnnnncgcgactggtcagctgcgggatcccaagggggagggctcacgccgcgctccggcggtcacccccaaaagcaggtcactcactttgcccctgtcgctttcgctgctcgcacgcccgcgcgctctctctgaccccgtctctctcttcctcgacttctctctggagctcttgctacctctttcctctttctgctggtttccaaaatccacagtgatttggggaagtagagcaatctccccaagccgtcggcccgattcaagtggggaatggcaagcaaaaataaattaaaacgagaaacaatacagttttaaaaaaaaatgtttaagaaaaaagaagagggataaaacccggatcaatgaatatcaaattccagcaccgagcgccctggccggtgagtccgctgaccggtccacctaaccgctgcgcctcccgacagagcgctggtgctagcccccagcgccacgacctccgagctacccggctgccccaag

SEQ ID NO: 167 - DNA, 3012 bp, Homo sapiens
  misc_feature: Incyte ID No: 220134.1
atttacaaaatatataagtatttttaaggatgttgacacctaataattacatgctaaacgcaaacgattaatgtaatcttttaaaccgggcgtttgaaaaaaaattttcaaggtcatttcatgataaccaatcatgaatggatttaaatggagctttttgtgcacaaccagcaatgtttgtgctttctaagagtcactgacttgagaggaaagaaaaccagaaggttaatgcagtttggatattaaattcttagcaaaattaataattaaagcaaaattaattaagattttgtaagtcatcctgtcttcacatactcagatcttccaatagtggcttattttgcaagatgccacaatatctacacagaaaattgtggctatttcattattgctatagatttcaaatccaacacaaatatttaagggtgtttaagttatatttttcttgatagagggtatgctttgtgacaaaattagatttttgtccttgaaaggattaatattagcatcagttatgtatagctctatttttctagaaacaaggtattctgactacttttatagctgactacttttgggatggctacgttttgggatttaaaatagttcattgtttaatgggttgtaagaggaaaaagtgttaggatttgacagttactttttaaagggatgatcttttgtggtgtgtgtttttcctagtataagcctattgctggcgatgggcctatttaagaacagctgattttttccagtgaaaatatggtaattttaggaacacagtttgtaagttcacatttactataatgggccaaaaccataacctgccagtttgcaatacatcttgatcttttaatattcttatctgatattgtgtaattcaattcctaaactgatagttaccttgaattttgcgaaaaggtttgggtggttttttttaaacatgaaattgagggatctcatctgggcgaacaagaagagaaagctgtgaattgtactgtatcatgtacattcctgatttaatactttacagaacattttattcagatatcaatttgttacataaacatttcagcaatgatacaaagataactgataaaatatattacattcaatgaggttttctttacaaatgctctacttgaggtctgtgtcttaaagatggcatgacacctaagtacaagacatcaactgaatgaggattttaaaaaatggtatataagcataggacaagggctatgtttgtttgtttttcaaaagtgctttgaagataacagcctttaggtttgagttatttcacttttcataatttttaagtagcttatatataatggtggtaccataggattttcttttttcaaatgactgtcggcagaaacagtgggcactgactcaccttttgagttttagcagagaattatttatttctttacaatgcactttctaacccattgtagctatattagcattatcttttaaaaaagacatgcttttgtatttaaatattgtaggatttaagtgtctttctcaaaatagcttattcctttctgaaagaaaatgagggaaatactctgaattattaggagacttaaacccaatatttaaatatgctattttataacactgcatcagttttaggagttgcatctctcctgctggctcttttatatttgagcaagatcagtgtagaatatgtgtttagaaacttgtctgttgtctcagtttagtgaaaaggaggtgctgcatgtgcctgaattaaaaccaagaaatttttccaagccaaatgcagccttagtgatgagagatttaattctccattgtcaccttttagcttttatgattgcttagttttttctgaaggatgtctgcattgtaaaactatggactaaaacctaaaaaacagaatcctcaaaaactttgctgtatgtgttttaacattttagagaacagtatgttgaataactaaggtatgtaacttgaataggaaaaatgtccatcaaatgcaccttggaaaatcacagtaggtagaaggctgtgttaaccgtttgtgtcttattaacatccttaagttaattttgaatttttgacagttttgagggaaaagacctatggaacctaatgtgaagtatttcgtatgttaactggtgttgagttgaagatttttactgtgtataagcagatatcatttgaatgataaaaatgtcattaacctgctgtcttaagatgttcacacaaatatggagagtaattctacaatataaaaatatttattttaatactgagtttcagttaagtcataaacagtgttaaaactcttgggaaggtgtaggggttttttgtttgtcatttttaaaattgaaactgtgtcatacagtgtttcacgtctctgaaattgggattataatagcactattttgatgtagctctaccgatactatgtggtaatgctattttgttttactaacaagctctggaatatttagcagtcattttcactggcacaagagccttttgtatgttattcaatttaaacttttaaaccaaaaattttatggtccagtgtctttggcaaaaagatgctggagggaatgtaacatacaattaatatgtggttatatatatatataaaaagacacaaattgccatgttatggttctgccttgaaacagcacaatgaagtgtatcagtatattctgtgattatgaaacttatatgttgtgttgttttgtgtcttctgttgcctgtcctttgggccagatgtgggccagttaaatgcagttatcatctcattaaatacagatgcagataaaatatctttagtgctgcaacattttacctaactttttgtatgttttcatgactgtgtgttattttccaaagctgttcctacctcaccatgaggctttatggattgttatgtattataaatgttctatatgagacagactactgtgtttcttctcatttattaaaagttaagtagaaaaataaactaattttaatatctaaaaaaaa

SEQ ID NO: 168 - DNA, 2024 bp, Homo sapiens
  misc_feature: Incyte ID No: 216331.1
  unsure 164-227: a, t, c, g, or other
gtgagactgtctcaagaaaaaatgaaaagtaattattattagagaaaaattaaacaataataaaatttaggccgtatcatctattattttctatatgcatagagaaaagtgaaagaatatacatattttgggaaaatgcctaggagctattacataaaataacnnnnnnnnnnnnnnnnnnnnnnnnnnnnnnnnnnnnnnnnnnnnnnnnnnnnnnnnnnnnnnnntctacacacaaaaagtttattttccttcctcttatttgatatcagaagaatgacaggaatcagtttttaacagagatagtttttccgtttctccattgtgttaatcagagcgcagacttacattctcagtcatttatcttttctggtggagaataaaaagtcacttatagttaaagatcagaaaattatcacaccaaatccattacatatgttagaatcaataatttactcaaaaatcagcttttataggtatgttggcaccttatccaagaacttatccctgttccagtacccctgtgcttcattcagtatcagtaaccctgcaatgatttttacaaatatctttttctagtgggttttttacttagaggaaagaactttgtaatagctcttaatgtttatatataagagaagacagaatggaaaatgttttttgaagtcaaatattgcatgatgtaaagaaaaaactttaaacttaaatgagtaggttgtcctgaattacactggtaactctctacttctttattaaagaagttatagtaagatgcctttgttacctgatttcagtgtacattgtttttatgtggttttctgataatgtcctgtcagaattgtattggtttaggccaaaggccatagcaaaaacatagagaacaaatatgatcttaaaaatagattgtaacattttaaacaattagtttagtaatttgggaaatagtggatgcataatactttaacagaagtcacacatctgtaggtttatcttttgattattctcctgaggcattagatagtttttctattataagtgacagattgactcacttaatataaataagtagcatacactaaaagcttactatgtgccagatactgtgctggacacttacatagataagccattgaatccacacagcagccctgtaagaaataagtaaaatctgcataaagtgttgaaataggaatatacatttcattatgaaaaatgaatagattatgcctatctgaatcaatattgcattcaaataagtgattacttaaatcatatatcatagtttacactccttaaaaaaaggtacataaattcagtgaggtttttttcttaacatacagaagtactaaatactgcttgcagtataatattgatattggaagctgcagtttccagaataagtggagtaataactaaacagacatttaattttatttcaatatctatggaaaaaacacttattaaatctccctgtattttatgttgtctttattacagaatcacttgtctgtttgttgtgtgccacttactgacaaaactttaaacagtacttgatgccagctctctactctgtggctgtgggacctgtttcttttaggtacttgtgcttattaatctacttactaaattttcacattgacatttttggggatgatactaccatatacgaaatggaaaatgtaatatgctcagtgcttctgtaaaatgcagcaatactggtattactttacatcagtaggcatctttgacatgagcatataaatattttgttgactcagcaaaggtgacactttgtgactaaagtatcccattatatataatgttttttgaaatgttggaaattttggggaattatcaaatgtatagaagttgcatgaaggttatagagaggtgtaactgtttgttaactattacatggatttcatactaggcagtgacaactaacatgttacttcaactaaaagtgtataatgggttgtctttttatttatgaaaataaaagtaattttacttacaataaaagg

SEQ ID NO: 169 - DNA, 580 bp, Homo sapiens
  misc_feature: Incyte ID No: 206044.1
  unsure 37, 62, 66, 351: a, t, c, g, or other
ctaaagaggagattcttctggagaaaacagttcagtnaaggtgccatgatgttccgtagtgncatnaccaagtggctatgacgaaactctctgcaccacctggaaaaccctaccagaaaaatatcacagccatctcacctcctgatgagggcaagctgaagcacttggagaagggattgcaggtggacacttctccagaggaaaacattactgtcacgcagggtcgtagacgtgtctgtacccaactccacatgacgggcacttcgacctgaagaagactctctcctacataggtgtctccaaaatctttgaggaacatggtgatctcaccaagatcgcccctcatcgcanctggaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgccac

SEQ ID NO: 170 - DNA, 505 bp, Homo sapiens
  misc_feature: Incyte ID No: 382906.16
  unsure 484: a, t, c, g, or other
gaagaaacatccaaggtggtcttgaaggacactgggatcctgtaacacagccccggatatctgtgttaccagccttgtctcggccacctcaaggataatcactaaattctgccaaaaggactgaggaacggtgcctggaaaagggcaagaatatcacggcatgggcatgagtagcttgaaactgctgaagtatgtcctgtttttcttcaacttgctcttttgggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaacccagagaagtgggtgttggccaggcacatccccatctcaggcagcaagacnatctttcactcactgacggca

SEQ ID NO: 171 - DNA, 2772 bp, Homo sapiens
  misc_feature: Incyte ID No: 331306.1
  unsure 2249, 2262: a, t, c, g, or other
gtcattttgaaagactgtgaaactggagccaattctccatcatcacacaggaagctgagtacttcctacttggtcaggatcttgaaacttgaattcataaaaacccagaaagccccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctgggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtccgccacttgggatagagagggaatgtaatggtggcctggggcttctgaggcttctggggcttcagtcttttccatgaacttctcccctggtagaaagaagatgaatgagcaaaaccaaatattccagagactggggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaanaaaaaaataatantaataataaggcctgctgtgtaagctgacagtatttgtagctgatagggggttgggaggaaagtgtctactaggagggtggggtgagattctgtgttgatgtaggaggccgagaaggcccttaactcaaagtagcttatttatccaaaatgttctggatgcatcatctccaaccaaggaccccttatttatcatgcctttgttctcttttccctcagatgtatatttctttaaaaataattttcctaataacaaaacttatttctaaaacagcttaaaaattcaaagaaaaaccccaaacactgacattacctacacttccactacccaaagacaaaatgtgcccactgtgtgcttttgagtgtattttcttttagtttgttttttgttgggtgcatatttatgataataacaatgatggacttcaattgtactcactgttctattgttggttttaattagcagcaagttgtgatcactttcccaggtgaataaatcatttcaaagcatt

SEQ ID NO: 172 - DNA, 1703 bp, Homo sapiens
  misc_feature: Incyte ID No: 1094829.20
  unsure 151-152: a, t, c, g, or other
ctccgcgctccggcggcgaaggaaagaacggactctgatcatagaagcctagtaaagtagtacacctctctcctttcgtgaggccataagaacaaactccttttctcgtcacagctacgccctgggcataaacggttggggcgtcaaaggnngggagggaagggagcgggcgggaggagacggtcacgtggtcgcggcggaaggatgcgtctgtgctgcgtccccatagagacgaagtctattaaagggccggcgggcggccacggcagccatttctactttgcccgcccacagatgtagttttctctgcgcgtgtgccgttttccctcctccccgccctcagggtccacgggccaccatggcgtattaggggcagcagtgcctgcggcacatgcagcattggcctttgcagcggcggcagcagcaccaggctctgcagcggcaacccccagcggcttaagccatggcgcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgaccagtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaagtaaaa

SEQ ID NO: 173 - DNA, 2019 bp, Homo sapiens
  misc_feature: Incyte ID No: 1094829.38
gttttctactttgcccgcccacagatgtagttttctctgcgcgtgtgcgttttccctcctcccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaaggtcccaggggtcttggctgttgccccacgaaacgtgcaggaaccaagatggcggcggcagggcggcggcgcgggcgtgagtcaagggcgggcggtgggcggggcgcggccgctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgacccgtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtagggaaaa

SEQ ID NO: 174 - DNA, 5722 bp, Homo sapiens
  misc_feature: Incyte ID No: 1135580.4
ggcggctcagacacggcccgagcgccgccggggacgcggacagagacccgcacgggcacgggcgctgcgctggaggctcccctcgcggtccggggctgcgcgaccatggcggacaaggaggccggcggcagcgacgggccccgagaaacggctcccacatctgcatattcatctccagcccggagtcttggggacacaggaataacgcctctgtccccctcccatattgtgaacgacactgactccaacgtctcagaacagcagtcatttctcgtggtggtggccgtcgactttgggaccacatccagtggctatgcctacagcttcaccaaggagccggaatgcatccatgtgatgaggcgatgggagggaggtgaccctggtgtgtccaatcagaagactccaaccaccatcttgctgactcccgagaggaagttccacagcttcgggtatgccgccagggacttttaccatgacctggatcccaatgaggccaagcagtggctgtacctggagaagttcaagatgaagctgcacaccactggggacctcaccatggatacagacctgacggcagcaaatggcaagaaagtcaaagcccttgaaatctttgcttatgccctgcagtactttaaggagcaggcgctgaaggagctgagtgaccaggcgggttcggagttcgagaactctgatgtcagatgggtcatcacggtgcctgccatctggaagcagccggccaagcagttcatgagacaagctgcctaccaggcaggcctggcctcccccgagaactcggagcagctcatcattgccttggagcctgaggcagcctctatctactgccgaaagctgcggctacaccagatgattgagctgagcagcaaggcagccgtcaatgggtacagcggcagtgacacagtaggagctgggtttacacaggctaaggaacacatacggcgtaatcggcagagtcggacctttttggtggagaatgtcataggagaaatctggtccgagctggaggaaggtgataagtatgtggttgtggacagtggcggtggcaccgtagacctgacagtccatcagatccggttaccggagggacaccttaaggaactgtataaagcaacaggcggaccctatggatctttagagagtagattatgagttcgaaaaacttctgtataaaatatttggagaggattttattgaacaattcaaaatcaaacgccctgcagcctgggttgacttaatgattgcgtttgagtctcgcaaaagggcggctgccccagacagaactaacccgctgaacatcaccctgcccttctccttcattgactactacaagaagttccgcgggcacagtgtggagcacgccttgcggaaaagcaatgtggatttggtgaagtggtcctcgcaggggatgctgcggatgagtccagatgccatgaacgccctttttaagccgaccatcgatagcatcattgagcatctccgggacctgtttcagaagcccgaggtgtccaccgtcaagttcctctttctggtgggcggctttgccgaggcgcccctgctgcagcaggcggtgcaggctgcttttggggaccagtgccggatcatcatcccccaggacgtgggcctcaccatcctcaagggtgccgtcctctttggcctggaccccgcggtcatcaaggtgcgccggtcgccgctcacctacggggtaggcgtgctgaaccgctacgtggagggcaagcacccgcctgagaagctgctggtgaaggatggcactcggtggtgcaccgacgtctttgacaagttcatctctgccgaccagtctgtggctctgggtgagctggtcaagcgtagctacaccccggccaagccctcccagctggtcattgtcatcaacatctacagctctgagcacgacaacgtcagcttcatcactgatcccggggtgaagaagtgtggcacgctccgcctggatctcacagggaccagtggcactgcggtgcccgcccggagggagatccagacccttatgcagttcggggacaccgagatcaaagccacagccattgatatagccacttcgaagagtgtcaaagttgggatcgacttcttaaattactaaccctcccgccccgctgcctgtccccttggactcaacttatctgcatctgctgacctcaaccttgactgttctttccctaaccttgaccctcaccattgcccatgtgaatttcagcagggaagatgagaacaatcagggctagaaataattagtgacttttgagggcacactggagtcagaaaaacagaaattaagattaaggtttaggcatagaaaattaaaggatcctggaggagcagctagttttcataggtacaaaagtggtgaaatggccacggagaagggaatcagtacatttctgcagcagtggttgcgctgctttgaacagatctccgttatgtagaatttaggatgccctattgctgtctttctagatttaaaatgagatctttgaaccaggaggagatcttcatctgagacttgtctttctaaattttttggatggccatcaatataaaatgccacccatctgcagttaatttcttttcctcatcatgtgattaaaagtggtgattcagtgggaactgggaatgtttttagctggtggtagaaggctgcctacactgggcactgttttagattctcatatcatttaaacagcaaggaggttcagggaagaataaccgtagccttgggtaatccactagggcttttgtgagtaggagagctgatacctcacattcttagcaggtgaaaacttgccatgatggaaacagatagtgaagagttactgacgtatcccaaattatatgctgtgacataaattcccagcatgcccagccctgatttctgagttcataagtaattctagtgaaccttagtaggaattctgggtaagaaaatgaggttgccattggtcttgtttgcatcaccaagaccagacatccagaagagcccctcaccttgaaaagcagacagattttaaattaaccccctccttcccactcaccttcatctccctaagagttttggccatttaattccacattttgaaaggaatacattggtgaaatttgggaagagaatctgtgctatgcaatgtttcattaaaatcttcagtttttcaagtctctctaaaaataatttgtagatctatacttgatgtattaagtcagttttttttcacagcgggcctgtggctcgcctgcatcagaattgcctgggtgcgtgttcagaacaggttcctggatctgagccctttttaactgaggccgactcttggagaggggcaccagaatctgcatttgtagtgtataccacatcgtggttcaactgaaattggagaaatactaacctgagattttgttgaagttcacacacagatcacagcccgccctctgcaggtgtcccctttgggctcctttaggaagagggcttccatgagaaggtgaccccataccttgccctcttggtcaatgggattggggctccacctggcttggagatggcccttttaaccctcacaggaagggccaggggaggaaaaaaattgcaagaaagcgacaccaagaacggagctgactgaggaaccaactggagggtcttcactctctccttccccagtgtacaaaaccagttttctgcaacattcaggagccaaatgaggaaaaagaatcaagaatctgactcacagcccatctgatctgttcaaagctgtcttttccacctgctgaaattcattaaatcactggaggcatgcataatgaatggagaatgagtgaacttccaatgcaacttggattcacaaacccattatcatagccaatatgcagattttaaacagcatttcacatttcatttgaccatgtcttctttttcgcatcgcctgctgcagaattccctactagaatgtgaaacaacgaacaaaccacagaacttagagtgtgctggttagtcacataacttagtagcaggattgtgtatccaggcacaaaggtgtctttgctaatgttctcttgctacctgccctgcttcaaacgctaaatggtatgggtctttctttgttgccagccatattctacaaataagacttttcaatatagttatgagtaatataattttatgtacatataatgttagaatattgtacagaatcttggtttctacgatgcgcttttcttgtttcaaaaagaggaaaatgcttgatttttgttgatgatacttttgttactgtccttaattttccatagtttggtttcttaattgtgctcactaagcatcgatctgtgctgatgccaagctatggactatgtacgcaagaccgagcaatagacagaggtgcctagggtccaaacacactgaacgcacgtggaccgcctggatcaggagcctcatcagacccttctccatgcacatccttcccaaacagtcacagattccattgaaaggagcagattctatcagttcttctgtgcagactttaagagctgaacgttctggttctggaagccatgtgactgcgcagaacaacctaagaaaccctttgtgtcctgaggggtcgttgacctctccttccgggtcggagcagtcactctgagggcaaagcgtggtccactgtgtgtgatgttttcaggatgctagggtcaaagaaagaaaccaagtggtacataagcccagcttttctgctgggctaagtgtaagtgtgagtaacatggtcaagcccctcttttttgggctaatgtaaagcctttcctgccttgcattaatgctatctccctgtgtactgtttctcttaaatgagcagatagaaatctgcagtgttggcagataggtgatggagaggatgataattttatcttctggccacagagctgcagccccagttgtcagagtccttaaatgaaacccccaaatccatccctccttccctacccccactggaatattctagaataagagcactggataagtacacttgaacacatttttctaaccttagaaaatacctacaaggcctgttgtcttgacccattactcaattgtccctggcatattatctgatcttcacgtttcttggaagcagaatcatcaaggctttcctttgtaactgccctttccgtacacagcaggcatgaataaatgctgagtaacagacaagttacagacaggaggggaaagaggaggaaccatacaactgtttttgcaaaatgatggctgagtccagattatagaggttgccttacccttagaatgttatttagaccaagtttagcttttagagtccaggtctggttaattgccagggtagcaaagaatcgcatgcaccaatgtaaacaggagtcagaatgcattattagtcaaagatcgaatttcacattgtagagatgtatagctgtgattaagctgcatatgtatgctgggaaacggcttgagtggatggctaatataaaagttgttggccataatgccacacctctcatctgcttgaaatatggaccagtattctaaaatatcagctactggggtctcattcactacaagataaattcaaacttcacagaactttgcagcagttcaccaccagacgggactgtgtctgcaaactctcttgtcttcacagacgcctaataaagcaaaactctgaatctc

SEQ ID NO: 175 - DNA, 1799 bp, Homo sapiens
  misc_feature: Incyte ID No: 196623.3
cggccccacccccgagcccccgcagccctagagccgcccaagggatggcgatggcgtacttggcttggagactggcgcggcgttcgtgtccgagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaattcaataaacactgagatgtatcatgaaattatgcgtgcacttaaagctgccagcaaggatgactcaatcatcactggtcatcactgttttaacaggaaatggtgactattacagtagtgggaatgatctgactaacttcactgatattccccctggtggagtagaggagaaagctaaaaataatgccgttttactgagggaatttgtgggctgttttatagattttcctaagcctctgattgcagtggtcaatggtccagctgtgggcatctccgtcaccctccttgggctattcgatgccgtgcattcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttctttctgaagttttcactgatagcacttttcagaaagaagtctggaccaggctgaaggcatttgcaaagcttcccccaaatgtcttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagattttagtttttatttttactacagtagtaatatatatgtcatagtggaaaataaaattttgaaagatatgaaaaagtaccaagaaaagctacaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattc

SEQ ID NO: 176 - DNA, 4244 bp, Homo sapiens
  misc_feature: Incyte ID No: 048488.32
ctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtgtccttctgagtgtcagaggaacggccagaccccgcgggccggagcagaacgcggccagggcagaaagcggcggcaggagaagcaggcagggggccggaggacgcagaccgagacccgaggcggaggcggaccgcgagccggccatgtcggtggtggggttggacgtgggctcgcagagctgctacatcgcggtagcccgggccgggggcatcgagaccatcgccaatgagttcagcgaccggtgcaccccgtcagtcatatcatttggatcaaaaaatagaacaatcggagttgcagccaaaaatcagcaaatcactcatgcaaacaatacggtgtctaacttcaaaagatttcatggccgagcattcaacgaccccttcattcaaaaggagaaggaaaacttgagttacgatttggttccattgaaaaatggtggagttggaataaaggtaatgtacatgggtgaagaacatctatttagtgtggagcagataacagccatgttgttgactaagctgaaggaaactgctgaaaacagcctcaagaaaccagtaacagattgtgttatttcagtcccctccttctttacagatgctgagaggcgatctgtgttagatgctgcacagattgttggcctaaactgtttaagacttatgaatgacatgacagctgttgctttgaattacggaatttataagcaggatctcccaagcctggatgagaaacctcggatagtggtttttgttgatatgggacattcagcttttcaagtgtctgcttgtgcttttaacaagggaaaattgaaggtactgggaacagcttttgatcctttcttaggaggaaaaaacttcgatgaaaagttagtggaacatttttgtgcagaatttaaaactaagtacaagttggatgcaaaatccaaaatacgagcactcctacgtctgtatcaggaatgtgaaaaactgaaaaagctaatgagctctaacagcacagaccttccactgaatatcgaatgctttatgaatgataaagatgtttccggaaagatgaacaggtcacaatttgaagaactctgtgctgaacttctgcaaaagatagaagtacccctttattcactgttggaacaaactcatctcaaagtagaagatgtgagtgcagttgagattgttggaggcgctacacgaattccagctgtgaaggaaagaattgccaaattctttggaaaagatattagcacaacactcaatgcagatgaagcagtagccagaggatgtgcattacagtgtgcaatactttccccggcatttaaagttagagaattttccgtcacagatgcagttccttttccaatatctctgatctggaaccatgattcagaagatactgaaggtgttcatgaagtctttagtcgaaaccatgctgctcctttctccaaagttctcacctttctgagaagggggccttttgagctagaagctttctattctgatccccaaggagttccatatccagaagcaaaaataggccgctttgtagttcagaatgtttctgcacagaaagatggagaaaaatctagagtaaaagtcaaagtgcgagtcaacacccatggcattttcaccatctctacggcatctatggtggagaaagtcccaactgaggagaatgaaatgtcttctgaagctgacatggagtgtctgaatcagagaccaccagaaaacccagacactgataaaaatgtccagcaagacaacagtgaagctggaacacagccccaggtacaaactgatgctcaacaaacctcacagtctcccccttcacctgaacttacctcagaagaaaacaaaatcccagatgctgacaaagcaaatgaaaaaaaagttgaccagcctccagaagctaaaaagcccaaaataaaggtggtgaatgttgagctgcctattgaagccaacttggtctggcagttagggaaagaccttcttaacatgtatattgagacagagggtaagatgataatgcaagataaattggaaaaagaaaggaatgatgctaaaaatgcagttgaggaatatgtgtatgagttcagagacaagctgtgtggaccatatgaaaaatttatatgtgagcaggatcatcaaaattttttgagactcctcacagaaactgaagactggctgtatgaagaaggagaggaccaagctaaacaagcatatgttgacaagttggaagaattaatgaaaattggcactccagttaaagttcggtttcaggaagctgaagaacggccaaaaatgtttgaagaactaggacagaggctgcagcattatgccaagatagcagctgacttcagaaataaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggaattgaacaacacatgtgaacccgttgtaacacaaccgaaaccaaaaattgaatcacccaaactggaaagaactccaaatggcccaaatattgataaaaaggaagaagatttagaagacaaaaacaattttggtgctgaacctccacatcagaatggtgaatgttaccctaatgagaaaaattctgttaatatggacttggactagataaccttaaattggcctattccttcaattaataaaatatttttgccatagtatgtgactctacataacatactgaaactatttatattttcttttttaaggatatttagaaattttgtgtattatatggaaaaagaaaaaaagcttaagtctgtagtctttatgatcctaaaagggaaaattgccttggtaactttcagattcctgtggaattgtgaattcatactaagctttctgtgcagtctcaccatttgcatcactgaggatgaaactgacttttgtcttttggagaaaaaaaactgtactgcttgttcaagagggctgtgattaaaatctttaagcatttgttcctgccaaggtagttttcttgcattttgctctccattcagcatgtgtgtgggtgtggatgtttataaacaagactaagtctgacttcataagggctttctaaaaccatttctgtccaagagaaaatgactttttgctttgatattaaaaattcaatgagtaaaacaaaagctagtcaaatgtgttagcagcatgcagaacaaaaactttaaactttctctctcactatacagtatattgtcatgtgaaagtgtggaatggaagaaatgtcgatcctgttgtaactgattgtgaacacttttatgagctttaaaataaagttcatcttatggtgtcatttctaaactgttgattttgtcactaatttaaaaaatgagatgagggagaatatgaattattctagcagaaatgaagttagtgtccagtttttcttttttactgcttatgttctctcttttctaagtgaaaatgtttttctcctgacagaaaaatagcatatgtttattacattaaagcattttaaaaatactataaagtgaataaaacttaaaatcttgccacccagaagaaaacattgttaacacttcgttatacatccttggagccttttacccctaatgatgggggtatatttgtgtgagtgtctatgttatagtgctgtaggctgtttttaaaaactctgtgccagggaaattagtaaatacagtcaagtgttgtaactgcataaatgtagtgagttcattataaagacatacttaaaaataccaatcttgctattggtagatttaggtgtttctcatttttgctgttctaaataatgctgcaatgaatctatctggttgttttgtaagcacaaaattgaagtagtgttggaggtaggggagaagacacatgcacttaggataggtgacaaccagctcctcactagggtgcaacagtttattcttttttttttttgggaaaagcgggggt

SEQ ID NO: 177 - DNA, 1469 bp, Homo sapiens
  misc_feature: Incyte ID No: 2767012CB1
ggcggaactttccagaacgctcggtgagaggcggaggagcggtaactaccccggctgcgcacagctcggcgctccttcccgctccctcacacaccggcctcagcccgcaccggcagtagaagatggtgaaagaaacaacttactacgatgttttgggggtcaaacccaatgctactcaggaagaattgaaaaaggcttataggaaactggctttgaagtaccatcctgataagaacccaaatgaaggagagaagtttaaacagatttctcaagcttacgaagttctctctgatgcaaagaaaagggaattatatgacaaaggaggagaacaggcaattaaagagggtggagcaggtggcggttttggctcccccatggacatctttgatatgttttttggaggaggaggaaggatgcagagagaaaggagaggtaaaaatgttgtacatcagctctcagtaaccctagaagacttatataatggtgcaacaagaaaactggctctgcaaaagaatgtgatttgtgacaaatgtgaaggtagaggaggtaagaaaggagcagtagagtgctgtcccaattgccgaggtactggaatgcaaataagaattcatcagataggacctggaatggttcagcaaattcagtctgtgtgcatggagtgccagggccatggggagcggatcagtcctaaagatagatgtaaaagctgcaacggaaggaagatagttcgagagaagaaaattttagaagttcatattgacaaaggcatgaaagatggccagaagataacattccatggtgaaggagaccaagaaccaggactggagccaggcgatattatcattgtgttagatcagaaggaccatgctgtttttactcgacgaggagaagaccttttcatgtgtatggacatacagctcgttgaagcactgtgtggcttccagaagccaatatctactcttgacaaccgaaccatcgtcatcacctctcatccaggtcagattgtcaagcatggagatatcaagtgtgtactaaatgaaggcatgccaatttatcgtagaccatatgaaaagggtcgcctaatcatcgaatttaaggtaaactttcctgagaatggctttctctctcctgataaactgtctttgctggaaaaactcctacccgagaggaaggaagtggaagagactgatgagatggaccaagtagaactggtggactttgatccaaatcaggaaagacggcgccactacaatggagaagcatatgaggatgatgaacatcatcccagaggtggtgttcagtgtcagacctcttaatgggccagtgaataacactcactgctggcatttaatgtgcagtagtgaatgagtgaaggactgtaatcataatatgctcactacttgctcttgtttttgttttaataaactatagtagtgttttaaaaagttaaatgaagaataaacgcaaat

SEQ ID NO: 178 - protein, 397 aa, Homo sapiens
  misc_feature: Incyte ID No: 2767012CD1
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 179 - DNA, 2019 bp, Homo sapiens
  misc_feature: Incyte ID No: 1651724CB1
gtgccgtggggctttgtcagtccctcctgtagccgccgccgccgccgcccgccgcccctctgccagcagctccggcgccacctcgggccggcgtctccggcgtctgcgcttccccatggggctggcctgccgcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggcaaaaaaaaaaaaaaa

SEQ ID NO: 180 - protein, 461 aa, Homo sapiens
  misc_feature: Incyte ID No: 1651724CD1
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 181 - DNA, 265 bp, Homo sapiens
  misc_feature: Incyte ID No: 206397.1
ccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcgcccaatctcgtctaaaatagtccttcaaatatgtatctcttatagccttcagttatcccaacaaaattatctaaagatttgtttatctatttattattatttttt

SEQ ID NO: 182 - DNA, 715 bp, Homo sapiens
  misc_feature: Incyte ID No: 461707.40
cccaaacctgccaccgacggccacttccgtttccccgatagtatttggggatctcgaagcgatacttccggctccccccaggtccccaagctttacttttgtggggcacgacgagaaagtccgcagccccaaacattcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctcaaaaaaa

SEQ ID NO: 183 - DNA, 962 bp, Homo sapiens
  misc_feature: Incyte ID No: 2706645CB1
cgaggcaatcctggctcccagcaagtccccggggctgcttggtcaatgcagccctgtgtgcaggcctggcagccctgccacccccgccctcggctcccattggctgccacggcctgcagtgggctgcaccagggttcatccatcctccctgggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagatggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcattatttgaaaacaaaaaaaaa

SEQ ID NO: 184 - protein, 92 aa, Homo sapiens
  misc_feature: Incyte ID No: 2706645CD1
MSELEKAMVALIDVFHQYSGREGDKHKLKKSELKELINNELSHFLEEIKEQEVVDKVMETLDNDGDGECDFQEFMAFVAMVTTACHEFFEHE

SEQ ID NO: 185 - DNA, 2578 bp, Homo sapiens
  misc_feature: Incyte ID No: 474372.7
  unsure 2154: a, t, c, g, or other
cactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccgggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttaattanttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtcttaaaa

SEQ ID NO: 186 - DNA, 2196 bp, Homo sapiens
  misc_feature: Incyte ID No: 3592543CB1
ggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtgtttcgggagtgtccagagagcctggtctccagccgcccccgggaggagagccctgctgcccaggcgctgttgacagcggcggaaagcagcggtacccacgcgcccgccgggggaagtcggcgagcggctgcagcagcaaagaactttcccggctgggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcacggggacgacagccagcgggtgcgtgcgctcttagagaaactttccctgtcaaaggctccggggggcgcgggtgtcccccgcttgccagagccctgttgcggccccgaaacttgtgcgcgcacccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgccggcggcgcagcggtgcaacggggcaggcatggtggctcccgcggtagcctcggtggcagggggcagcggcagcgtcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttgcgtcctgacggcgcccccagtgtgcacgagtgggaaggacttggcgcgccctcccttggcgtggagccagg

SEQ ID NO: 187 - protein, 331 aa, Homo sapiens
  misc_feature: Incyte ID No: 3592543CD1
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTPAAQRCNGAGMVAPAVASVAGGSGSVGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 188 - DNA, 1427 bp, Homo sapiens
  misc_feature: Incyte ID No: 048612.12c
  unsure 217-266: a, t, c, g, or other
ccaagaagtagtaagggggaaatattgcaattatgtaaaggtaaggaacaatggtgtataaaaataatttaagcacaatattaataacaaagcaactttttttcaaggaaaactagtaggtcatcttgcccaagatttttccaaaggtattaaatatattttcaataacagtacatacaaatacacatacacaaatataccacacagacacatgtgnnnnnnnnnnnnnnnnnnnnnnnnnnnnnnnnnnnnnnnnnnnnnnnnnntacagctcaagtatttttttggtgtgcattctagctaatccacatagctaaagtgaaaaaacactgaaaagatcaatgcctgagtaaccttaaatttgaacaaactatgcattggatgtgaatttttggaggcatgctaagatttcccttctcaatttcattagctactacccagtgttctgtggttcttatccttaaaaaaatcaaagtgtgcctttcagatctgctcacggtgtggtgatgattattatggtggcgtcaatttgggaacacttgccctctcttgctcctactgcaccttatggatgggaaagggaatgattttaaaggtaaagcactcaggccctgattacatctggcttattctttgcttcaaggcaaggatctctctctcgatttcacaggggaggtcggcattgacttgatcctccagatacttctcgatgtcttccacctccttctcccagaattccttggagatgctgaaaagctccatcatgttgatgtgccccaggcctttcaggttcagggcatcctccttggggatgtagcctatgggcgtgagcttggtgctggcttttccatcgatccggttgaacatccactccagcaccctggagttctctccaaagcctggccagaggaatttgccttccttgtccttccggaaccagttgacatggaagatcttgggcagtttggctgctgggtgctgggccatgctaagccagtgggccaggtatttgccgaagttgtagccaaagaagggccgcatggcaaaggggtcatgcatgatgattttgcctttatgttctgcagccgctgtggcctctgatctcatggccgcccccacaaagactccatgttgccagctgagagcttcatagactagagggacacctttagcaggaaaaaaaaagagaaatgttcatcagaggctttgaaattcagactccacaaccagtggtgttattcacaacacggaaagacacggcaagacaataactttgtaatcgagctagttttgcgttcaccaagctaaattgcagaaaactgctaactcaaagttacatgactgaggccacaaagtaaaaagtaaaatttgatcaagctacaatagatcagggattcagaaaggttccaggtgaccagaagggttgg

SEQ ID NO: 189 - DNA, 2666 bp, Homo sapiens
  misc_feature: Incyte ID No: 048612.13
  unsure 2365, 2367-2399: a, t, c, g, or other
cactgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctaccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcacctctgtcgaagatcggcatcgagctgacggattcgccctacgtggtggccagcatgcggatcatgacgcggatgggcacgcccgtcctggaagcactgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggcgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagaataagccagatgtaatcagggcctgagtgctttacctttaaaatcattccctttcccatccataaggtgcagtaggagcaagagagggcaagtgttcccaaattgacgccaccataataatcatcaccacaccgggagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgancnnnnnnnnnnnnnnnnnnnnnnnnnnnnnnnnncgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaag

SEQ ID NO: 190 - DNA, 2358 bp, Homo sapiens
  misc_feature: Incyte ID No: 245259.16
gcagtctggttggagctgttgtcttgtatgctcagcgaggcccggagagacccgggagagagctaggccgagtccaccgcccgagtctgctgcccgagcccgcgttacgcacaaagccgccgatccccggcctggggtgagcagagcgaccaccgcccgggagcagcgcggcgagacgcacggtgcgccctatgcccccgcgcccccaccgcccccgccgcggcagccgaagcgcagcgagagaacgcgccaccgcggggcccgggtgcagctagcgaccctctcgccacctgcgcgcagcccgaggtgagcagtgagcggcgagcgggagggcagcgaggcgttcgcgggccccctcctgctgcccgggcccggcccgctcatggcggccatccgcaagaagctggtggtggtgggcgacggcgcgtgtggcaagacgtgcctgctgatcgtgttcagtaaggacgagttccccgaggtgtacgtgcccaccgtcttcgagaactatgtggccgacattgaggtggacggcaagcaggtggagctggcgctgtgggacacggcgggccaggaggactacgaccgcctgcggccgctctcctacccggacaccgacgtcattctcatgtgcttctcggtggacagcccggactcgctggagaacatccccgagaagtgggtccccgaggtgaagcacttctgtcccaatgtgcccatcatcctggtggccaacaaaaaagacctgcgcagcgacgagcatgtccgcacagagctggcccgcatgaagcaggaacccgtgcgcacggatgacggccgcgccatggccgtgcgcatccaagcctacgactacctcgagtgctctgccaagaccaaggaaggcgtgcgcgaggtcttcgagacggccacgcgcgccgcgctgcagaagcgctacggctcccagaacggctgcatcaactgctgcaaggtgctatgagggccgcgcccgtcgcgcctgcccctgccggcacggctccccctcctggaccagtcccccgcgagcccggagaaggggagacccgtgtcccacaaggaccccaccggcctgcctggcatctgtctgctgacgcctctggcttgcgccaggacttggcgtgggcaccgggcgcccccatcccagtgtctgtgtgcgtccagctgtgttgcacaggcctgggctccccactgagtgccaagggtcccctgagcatgcttttctgaagagccgggcctcagagtgtgtggctgtgtgtctgttcgactcccctcgccccattttcaccccacccccgcctctgatccccgggggcgagattggcgcgggagtgtggccgcgccccatcagatgttctcccttcaccagcgggagcttgatatcccttgtctgtaacatagaccccgggtactgcgggaggggagggctgctggggaggatggggggatgttatataaatatagatataattttattttcggagctaagatggtgttatttaagggtggtgatgggtgagcgctctggcccaggctgggccagactcccgcccaagcatgaacaggacttgaccatctttccaacccctggggaagacatttgcaactgacttggggaggacacagcttcagcacagcctctcctgcgggccagcccgctgcgaaccctccaccagctaccggagggaggagggaggatgcgctgtggggttgtttttgccataagcgaactttgtgcctgtcctagaagtgaaaattgttcagtccaagaaactgatgttatttgatttatttaaaggctaaaatttgtttttttattctttgcacaattgtttcattgtttgacacttaatgcactcgtcatttgcatacgacagtagcattctgaccacacttgtacgctgtaacctcatctacttctgatgtttttaaaaaatgacttttaacaaggagagggaaaagaaacccactaaattttgctttgtttccttgaagaatgtggcaacactgttttgtgattttatttgtgcaggtcatgcacacagttttgataaagggcagtaacaagtattggggcctattttttttttttttccacaaggcattctctaaagctatgtgaaattttctctgcacctctgtacagagaatacacctgcccctgtatatccttttttcccctcccctccctcccagtggtacttctactaaattgttgtcttgttttttattttttaaataaactgacaaatgacaaaatggtgagcttatgatgtttacataaaagttctataagctgtgtatacagttttttatgtaaaatattaaaagactatgatgatgacattt

SEQ ID NO: 191 - DNA, 1273 bp, Homo sapiens
  misc_feature: Incyte ID No: 522433CB1
gccgcaacctgcacagccatgcccgggcaagaactcaggacgctgaatggctctcagatgctcctggtgttgctggtgctctcgtggctgccgcatgggggcgccctgtctctggccgaggcgagccgcgcaagtttcccgggaccctcagagttgcacaccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgacctctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggaggcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttaaaaaaaaaaaaaaaaaaaaaaaaaaaaatggttgcggccgcaagcttattccctttagtgagggttaattttagcttgcactgacc

SEQ ID NO: 192 - protein, 308 aa, Homo sapiens [sequence omitted]

SEQ ID NO: 193 - DNA, 372 bp, Homo sapiens
  misc_feature: Incyte ID No: 1040667.43
  unsure 48: a, t, c, g, or other
gttataaaggtctcaaacacctttggaacaagacccattaaaacaaanttaccaccttaggcttattttcttgagaatctggcaaaagctatagactcagaaaagtgtacataacacaaacttgtacccaatttctgggattctggaaggcctcgagccgctcgagccgaattcggctcgagttctcacataacagtagaaaaccaaaatttgttgtcatctcttcaaagaatcgagaattgcgtacaaaaaaaaccttacataattaagaatgaatacatttacaggcgtaaatgcaaaccgattccaactcaaagcaagtaacagcccacggtgttctggccaaagtcatcagctaagaaaggaaactgg

SEQ ID NO: 194 - DNA, 558 bp, Homo sapiens
  misc_feature: Incyte ID No: 2048551CB1
gacttctcatatcttgcctaggaactccaggcttgtcttggctccaaatggatcccaactgctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggattttttttttaactaccctgaccggtttgctacattcttttttctattcaatatgtgaaagacaataaaacacgtttgacttgaaaaaaggcataacattacctggaagggatttcccaaaaatatgaaaacctcgggggcggacccccctagtctattcagcccaccggatatttactccgccgatgaaaaccgggccaaaaaactttctcaaaactagggcccggagagaccttgccgtctatcttggccgaatgcttggcatccagcc

SEQ ID NO: 195 - protein, 61 aa, Homo sapiens
  misc_feature: Incyte ID No: 2048551CD1
MDPNCSCTTGGSCACAGSCKCKECKCTSCKKCCCSCCPVGCAKCAQGCVCKGSSEKCRCCA

SEQ ID NO: 196 - DNA, 3033 bp, Homo sapiens
  misc_feature: Incyte ID No: 1969731CB1
ctggctcccagctggtgctgaagctcgtcagttcaccatccgccctcggcttccgcggggcgctgggccgccagcctcggcaccgtcctttcctttctccctcgcgttaggcaggtgacagcagggacatgtctcgggagatgcaggatgtagacctcgctgaggtgaagcctttggtggagaaaggggagaccatcaccggcctcctgcaagagtttgatgtccaggagcaggacatcgagactttacatggctctgttcacgtcacgctgtgtgggactcccaagggaaaccggcctgtcatcctcacctaccatgacatcggcatgaaccacaaaacctgctacaaccccctcttcaactacgaggacatgcaggagatcacccagcactttgccgtctgccacgtggacgcccctggccagcaggacggcgcagcctccttccccgcagggtacatgtacccctccatggatcagctggctgaaatgcttcctggagtccttcaacagtttgggctgaaaagcattattggcatgggaacaggagcaggcgcctacatcctaactcgatttgctctaaacaaccctgagatggtggagggccttgtccttatcaacgtgaacccttgtgcggaaggctggatggactgggccgcctccaagatctcaggatggacccaagctctgccggacatggtggtgtcccacctttttgggaaggaagaaatgcagagtaacgtggaagtggtccacacctaccgccagcacattgtgaatgacatgaaccccggcaacctgcacctgttcatcaatgcctacaacagccggcgcgacctggagattgagcgaccaatgccgggaacccacacagtcaccctgcagtgccctgctctgttggtggttggggacagctcgcctgcagtggatgccgtggtggagtgcaactcaaaattggacccaacaaagaccactctcctcaagatggcggactgtggcggcctcccgcagatctcccagccggccaagctcgctgaggccttcaagtacttcgtgcagggcatgggatacatgccctcggctagcatgacccgcctgatgcggtcccgcacagcctctggttccagcgtcacttctctggatggcacccgcagccgctcccacaccagcgagggcacccgaagccgctcccacaccagcgagggcacccgcagccgctcgcacaccagcgagggggcccacctggacatcacccccaactcgggtgctgctgggaacagcgccgggcccaagtccatggaggtctcctgctaggcggcctgcccagctgccgcccccggactctgatctctgtagtggccccctcctccccggccccttttcgccccctgcctgccatactgcgcctaactcggtattaatccaaagcttattttgtaagagtgagctctggtggagacaaatgaggtctattacgtgggtgccctctccaaaggcggggtggcggtggaccaaaggaaggaagcaagcatctccgcatcgcatcctcttccattaaccagtggccggttgccactctcctcccctccctcagagacaccaaactgccaaaaacaagacgcgtagcagcacacacttcacaaagccaagcctaggccgccctgagcatcctggttcaaacgggtgcctggtcagaaggccagccgcccacttcccgtttcctctttaactgaggagaagctgatccagtttccggaaacaaaatccttttctcatttggggaggggggtaatagtgacatgcaggcacctcttttaaacaggcaaaacaggaagggggaaaaggtgggattcatgtcgaggctagaggcatttggaacaacaaatctacgtagttaacttgaagaaaccgatttttaaagttggtgcatctagaaagctttgaatgcagaagcaaacaagcttgatttttctagcatcctcttaatgtgcagcaaaagcaggcaacaaaatctcctggctttacagacaaaaatatttcagcaaacgttgggcatcatggtttttgaaggctttagttctgctttctgcctctcctccacagccccaacctcccacccctgatacatgagccagtgattattcttgttcagggagaagatcatttagatttgttttgcattccttagaatggagggcaacattccacagctgccctggctgtgatgagtgtccttgcaggggccggagtaggagcactggggtgggggcggaattggggttactcgatgtaagggattccttgttgttgtgttgagatccagtgcagttgtgatttctgtggatcccagcttggttccaggaattttgtgtgattggcttaaatccagttttcaatcttcgacagctgggctggaacgtgaactcagtagctgaacctgtctgacccggtcacgttcttggatcctcagaactctttgctcttgtcggggtgggggtgggaactcacgtggggagcggtggctgagaaaatgtaaggattctggaatacatattccatgggactttccttccctctcctgcttcctcttttcctgctccctaacctttcgccgaatggggcagcaccactgacgtttctgggcggccagtgcggctgccaggttcctgtactactgccttgtacttttcattttggctcaccgtggattttctcataggaagtttggtcagagtgaattgaatattgtaagtcagccactgggacccgaggatttctgggaccccgcagttgggaggaggaagtagtccagccttccaggtggcgtgagaggcaatgactcgttacctgccgcccatcaccttggaggccttccctggccttgagtagaaaagtcggggatcggggcaagagaggctgagtacggatgggaaactattgtgcacaagtctttccagaggagtttcttaatgagatatttgtatttatttccagaccaataaatttgtaactttgcaaaaacaaaaaaaaaaaa

SEQ ID NO: 197 - protein, 394 aa, Homo sapiens
  misc_feature: Incyte ID No: 1969731CD1
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 198 - DNA, 4848 bp, Homo sapiens
  misc_feature: Incyte ID No: 1326983.14
  unsure 4793, 4798, 4806, 4809-4810, 4815-4816, 4824-4825, 4828, 4830,4832-4833, 4842-4843: a, t, c, g, or other
cgacgccgccgccttagaacgcctttccagtactgctagcagcagcccgaccacgcgttaccgcacgctcgcgcctttcccttgacacggcggacgccgggaggattggggcggcaatttgtcttttccttttttattaaaattatttttcctgcctgttgttggatttggggaaattttttgtttgttttttatgatttgtattgactgagagaaacccactgaagacgtctgcgtgagaatagagaccaccgagtttcgcaggccgactcgcggggccgctgcacccaccgccaaggacaaaaggagcccagcgctactagctgcacccgattcctcccagtgcttagcatgaagaaggcccgaaatgggacgattcagtatttccccgggatgaagacagcagcaagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggcttcttatgccatggctaatactggaatgctcttttataattctctgacatttgtgtcaatatttccctgtatctgttcatctcctttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttccttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagacttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctgaaaaanaaaanaaaaaaanaannaaaannaaaaaaannaangngnnaaaaaaaannggggg

SEQ ID NO: 199 - DNA, 3928 bp, Homo sapiens
  misc_feature: Incyte ID No: 2120743CB1
ccctcgagccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaattttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaatttttc

SEQ ID NO: 200 - protein, 697 aa, Homo sapiens
  misc_feature: Incyte ID No: 2120743CD1
MCKSLRYCFSHCLYLAMTRLEEVNREVNMHSSVRYLGYLARINLLVAICLGLYVRWEKTANSLILVIFILGLFVLGIASILYYYFSMEAASLSLSNLWFGFLLGLLCFLDNSSFKNDVKEESTKYLLLTSIVLRILCSLVERISGYVRHRPTLLTTVEFLELVGFAIASTTMLVEKSLSVILLVVALAMLIIDLRMKSFLAIPNLVIFAVLLFFSSLETPKNPIAFACFFICLITDPFLDIYFSGLSVTERWKPFLYRGRICRRLSVVFAGMIELTFFILSAFKLRDTHLWYFVIPGFSIFGIFWMICHIIFLLTLWGFHTKLNDCHKVYFTHRTDYNSLDRIMASKGMRHFCLISEQLVFFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMIETYGCDYSTSGLSFDTLHSKLKAFLELRTVDGPRHDTYILYYSGHTHGTGEWALAGGDTLRLDTLIEWWREKNGSFCSRLIIVLDSENSTPWVKEVRKINDQYIAVQGAELIKTVDIEEADPPQLGDFTKDWVEYNCNSSNNICWTEKGRTVKAVYGVSKRWSDYTLHLPTGSDVAKHWMLHFPRITYPLVHLANWLCGLNLFWICKTCFRCLKRLKMSWFLPTVLDTGQGFKLVKS

SEQ ID NO: 201 - DNA, 436 bp, Homo sapiens
  misc_feature: Incyte ID No: 3551330CB1
cccacgcgtccgcagcccgtgccgccccagccgctgccgcctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaaaaaaaaaa

SEQ ID NO: 202 - protein, 77 aa, Homo sapiens
  misc_feature: Incyte ID No: 3551330CD1
MPKCPKCNKEVYFAERVTSLGKDWHRPCLKCEKCGKTLTSGGHAEHEGKPYCNHPCYAAMFGPKGFGRGGAESHTFK

SEQ ID NO: 203 - DNA, 2336 bp, Homo sapiens
  misc_feature: Incyte ID No: 1440032CB1
cgggctggctgcagagaaaccgcagggcgagcctcactgctgagcgcccctcgacggcggagcggcagcagcctccgtggcctccagcatccgacaagaagcttcagccatgcaggccccacgggagctcgcggtgggcatcgacctgggcaccacctactcgtgcgtgggcgtgtttcagcagggccgcgtggagatcctggccaacgaccagggcaaccgcaccacgcccagctacgtggccttcaccgacaccgagcggctggtcggggacgcggccaagagccaggcggccctgaacccccacaacaccgtgttcgatgccaagcggctgatcgggcgcaagttcgcggacaccacggtgcagtcggacatgaagcactggcccttccgggtggtgagcgagggcggcaagcccaaggtgcgcgtatgctaccgcggggaggacaagacgttctaccccgaggagatctcgtccatggtgctgagcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctggaccggcggggcgcgggagagcgcaacgtgctcatttttgacctgggtgggggcaccttcgatgtgtcggttctctccattgacgctggtgtctttgaggtgaaagccactgctggagatacccacctgggaggagaggacttcgacaaccggctcgtgaaccacttcatggaagaattccggcggaagcatgggaaggacctgagcgggaacaagcgtgccctgcgcaggctgcgcacagcctgtgagcgcgccaagcgcaccccgtcctccagcacccaggccaccctggagatagactccctgttcgagggcgtggacttctacacgtccatcactcgtgcccgctttgaggaactgtgctcagacctcttccgcagcaccctggagccggtggagaaggccctgcgggatgccaagctggacaaggcccagattcatgacgtcgtcctggtggggggctccacacgcatccccaaggtgcagaagttgctgcaggacttcttcaacggcaaggagctgaacaagagcatcaaccctgatgaggctgtggcctatggggctgctgtgcaggcggccgtgttgatgggggacaaatgtgagaaagtgcaggatctcctgctgctggatgtggctcccctgtctctggggctggagacagcaggtggggtgatgaccacgctgatccagaggaacgccactatccccaccaagcagacccagactttcaccacctactcggacaaccagcctggggtcttcatccaggtgtatgagggtgagagggccatgaccaaggacaacaacctgctggggcgttttgaactcagtggcatccctcctgccccacgtggagtcccccagatagaggtgacctttgacattgatgctaatggcatcctgagcgtgacagccactgacaggagcacaggtaaggctaacaagatcaccatcaccaatgacaagggccggctgagcaaggaggaggtggagaggatggttcatgaagccgagcagtacaaggctgaggatgaggcccagagggacagagtggctgccaaaaactcgctggaggcccatgtcttccatgtgaaaggttctttgcaagaggaaagccttagggacaagattcccgaagaggacaggcgcaaaatgcaagacaagtgtcgggaagtccttgcctggctggagcacaaccagctggcagagaaggaggagtatgagcatcagaagagggagctggagcaaatctgtcgccccatcttctccaggctctatggggggcctggtgtccctgggggcagcagttgtggcactcaagcccgccagggggaccccagcaccggccccatcattgaggaggttgattgaatggcccttcgtgataagtcagctgtgactgtcagggctatgctatgggccttctagactgtcttctatgatcctgcccttcagagatgaactttccctccaaagctagaactttcttcccaggataactgaagtcttttgactttttgcggggagggcggttcatcctcttctgcttcaaataaaaagtcattaatttattaaaacttgtgtggcactttaacattgctttcacctatattttgtgtactttgttacttgcatgtatgaattttgttatgtaaaatatagttat

SEQ ID NO: 204 - protein, 643 aa, Homo sapiens
  misc_feature: Incyte ID No: 1440032CD1
MQAPRELAVGIDLGTTYSCVGVFQQGRVEILANDQGNRTTPSYVAFTDTERLVGDAAKSQAALNPHNTVFDAKRLIGRKFADTTVQSDMKHWPFRVVSEGGKPKVRVCYRGEDKTFYPEEISSMVLSKMKETAEAYLGQPVKHAVITVPAYFNDSQRQATKDAGAIAGLNVLRIINEPTAAAIAYGLDRRGAGERNVLIFDLGGGTFDVSVLSIDAGVFEVKATAGDTHLGGEDFDNRLVNHFMEEFRRKHGKDLSGNKRALRRLRTACERAKRTPSSSTQATLEIDSLFEGVDFYTSITRARFEELCSDLFRSTLEPVEKALRDAKLDKAQIHDVVLVGGSTRIPKVQKLLQDFFNGKELNKSINPDEAVAYGAAVQAAVLMGDKCEKVQDLLLLDVAPLSLGLETAGGVMTTLIQRNATIPTKQTQTFTTYSDNQPGVFIQVYEGERAMTKDNNLLGRFELSGIPPAPRGVPQIEVTFDIDANGILSVTATDRSTGKANKITITNDKGRLSKEEVERMVHEAEQYKAEDEAQRDRVAAKNSLEAHVFHVKGSLQEESLRDKIPEEDRRKMQDKCREVLAWLEHNQLAEKEEYEHQKRELEQICRPIFSRLYGGPGVPGGSSCGTQARQGDPSTGPIIEEVD

SEQ ID NO: 205 - DNA, 775 bp, Homo sapiens
  misc_feature: Incyte ID No: 1000133.1
  unsure 43: a, t, c, g, or other
gcgaggagcagcccgcgctgctcccgcccctcgggtgccagcnccgcccctggctgcggcgggtgaggggcggggcggggcgcggcgtatataaggctaggggcgggcgccgctcttttgtttcttgctgcagcaacgcgagtgggagcaccaggatctcgggctcggaacgagactgcacggattgttttaagaaaatggcagacaaacccagacatgggggaaatcgccagcttcgataaggccaagctgaagaaaacggagacgcaggagaagaacaccctgccgaccaaagagaccattgagcaggagaagcggagtgaaatttcctaagatcctggagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaacttcccaccaaaaaaaagttgcatattttggtaagtgtttgtcctagagggaaaaaacaactgaaatttacattagcagtgctgtgcaagattcttacataattcaagacctaaaaccagcctgcagtggaggtttcagtcctctgttcaggtgcttagacagaagccataagctga

SEQ ID NO: 206 - DNA, 556 bp, Homo sapiens
  misc_feature: Incyte ID No: 4020439CB1
ctttgggaggccaaggtgggaagattgcttgagcctcagaggttgagaccagcccgggcaacatggtgaaacccatctctaataaaaatacaaaaattagtgcttcctccagtccgtgcctccaatatgatgaaaaaaagaaggaacaacggtcgtaccaaaaagggccgcggccacgtgcagcctatttgcgacacgaactgtgcccaatgtgtgcccaaggacaaggctattaacaaattcatcattggaaacacagtggaggctgcagcagtcagggacatttctgaagcgagcgtctttgatgcctatgtgcttcccaagctgtatttgaagctacattactgtctgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtacttaaaaaaaaaaaaaaa

SEQ ID NO: 207 - protein, 115 aa, Homo sapiens
  misc_feature: Incyte ID No: 4020439CD1
MMKKRRNNGRTKKGRGHVQPICDTNCAQCVPKDKAINKFIIGNTVEAAAVRDISEASVFDAYVLPKLYLKLHYCLSCAIHSKVVRNRSREARKDRTPPPRFRPAGAAPRPPPKPM

SEQ ID NO: 208 - DNA, 4240 bp, Homo sapiens
  misc_feature: Incyte ID No: 2507087CB1
ttttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaaagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattgggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtacaatgactggtggtggaagcaaagtaatgaaaggaagaatgggttcctcacttgttattgaaatctctgaagaagaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccagcgtttaatagagcaagaagaatatttgaatgtccaagttaaggaacttgaagctaatgtacttgctacagcccctgacaaaaaaaagcagaaattgctagaagaaaacgttagtgctttcaaaacagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatg

SEQ ID NO: 209 - protein, 1288 aa, Homo sapiens
  misc_feature: Incyte ID No: 2507087CD1
MPRKGTQPSTARRREEGPPPPSPDGASSDAEPEPPSGRTESPATAAETASEELDNRSLEEILNSIPPPPPPAMTNEAGAPRLMITHIVNQNFKSYAGEKILGPFHKRFSCIIGPNGSGKSNVIDSMLFVFGYRAQKIRSKKLSVLIHNSDEHKDIQSCTVEVHFQKIIDKEGDDYEVIPNSNFYVSRTACRDNTSVYHISGKKKTFKDVGNLLRSHGIDLDHNRFLILQGEVEQIAMMKPKGQTEHDEGMLEYLEDIIGCGRLNEPIKVLCRRVEILNEHRGEKLNRVKMVEKEKDALEGEKNIAIEFLTLENEIFRKKNHVCQYYIYELQKRIAEMETQKEKIHEDTKEINEKSNILSNEMKAKNKDVKDTEKKLNKITKFIEENKEKFTQLDLEDVQVREKLKHATSKAKKLEKQLQKDKEKVEEFKSIPAKSNNIINETTTRNNALEKEKEKEEKKLKEVMDSLKQETQGLQKEKESREKELMGFSKSVNEARSKMDVAQSELDIYLSRHNTAVSQLTKAKEALIAASETLKERKAAIRDIEGKLPQTEQELKEKEKELQKLTQEETNFKSLVHDLFQKVEEAKSSLAMNRSRGKVLDAIIQEKKSGRIPGIYGRLGDLGAIDEKYDVAISSCCHALDYIVVDSIDIAQECVNFLKRQNIGVATFIGLDKMAVWAKKMTEIQTPENTPRLFDLVKVKDEKIRQAFYFALRDTLVADNLDQATRVAYQKDRRWRVVTLQGQIIEQSGTMTGGGSKVMKGRMGSSLVIEISEEEVNKMESQLQNDSKKAMQIQEQKVQLEERVVKLRHSEREMRNTLEKFTASIQRLIEQEEYLNVQVKELEANVLATAPDKKKQKLLEENVSAFKTEYDAVAEKAGKVEAEVKRLHNTIVEINNHKLKAQQDKLDKINKQLDECASAITKAQVAIKTADRNLQKAQDSVLRTEKEIKDTEKEVDDLTAELKSLEDKAAEVVKNTNAAEESLPEIQKEHRNLLQELKVIQENEHALQKDALSIKLKLEQIDGHIAEHNSKIKYWHKEISKISLHPIEDNPIEEISVLSPEDLEAIKNPDSITNQIALLEARCHEMKPNLGAIAEYKKKEELYLQRVAELDKITYERDSFRQAYEDLRKQRLNEFMAGFYIITNKLKENYQMLTLGGDAELELVDSLDPFSEGIMFSVRPPKKSWKKIFNLSGGEKTLSSLALVFALHHYKPTPLYFMDEIDAALDFKNVSIVAFYIYEQTKNAQFIIISLRNNMFEISDRLIGIYKTYNITKSVAVNPKEIASKGLC

SEQ ID NO: 210 - DNA, 931 bp, Homo sapiens
  misc_feature: Incyte ID No: 239996.1
  unsure 26, 32, 892, 908, 918: a, t, c, g, or other
caactacaaacagactttgggcaggnaaggcnggcgggcgggggtgggggtgggggcgggggcctgctttgatcgctccagctctgttgtaattttgtcttcgccagatagattagctggaaccgccagccctagcttggagttccgttccacggagtaccctccctccccacccccagcgtcatctcgcgcctggagccgggtcgccgctccttccgaagtctcgctggaaacttcaagggctgatggttctgtgttcttgacgtaattaggaggccacgcagctctccaacactccgttaaacaaatatactcctgcaggctcagatttgaagagggaaggttccagccaagtccaccttaagcctgagtttgggcgactacagaatccaggaagaaaatctagatggcatggtcgctccggtctcagttctacaggggagggaagaaagggggtgttagtggggatatttgctgttcatttttcccgcaatctcccttccaaatcagtcactgattaatgagcaaagcccatgccacaagttatagattactgtggactgaggatcattttgttaatatcaggcaagaaacttgccttacttgcatccctgtgtctgtatttacagtaacaacttccttagtcacaaactgatatgcttttagccataccttttcttcttacttacttatttttagcatcatcaggagttgggataggaaataacatgggggaggggtgtgttaaagggaaggaaggaaaagccatcctttatcccagagtgtcctggaggtacgcctacactcctgtttaacatcttgtggttgtagtgccttctccaagccctagatggaggaggaaagagttggaagcctcctcaaatctgcctangaaagggtaaaactgnggaaactggnaccctagctatga

SEQ ID NO: 211 - DNA, 1565 bp, Homo sapiens
  misc_feature: Incyte ID No: 1097380.1
caacagagtggcggccgctacggccctggaacggggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctccacctccttggtgactccaagtactcacacagtcatcacccctccccgcacacagatggccacttctgcctccatccactcaacgccaacaggcaccattcctccaccgacaacgctcaaggccacagggtccacccacacagcgccaacaaggacgctgaccaccagcgggaccagccaagccctgagctcattaaacacagccaaaacctctacatccctacattcacacacttcctccacacaccatcctgaagccacctcaacttctaccaccaacatcacccccaaccccaccagtacaggaactgggacacctgtggggtttcgggttcggggtttcctggtgggcgtcaggggcaggcaacagagtggcggccgctacggccctgtaacagggccatggagaagctgcggcgagtcctgagcggccaggacgacgaggagcagggcctgactgcgcaggattcacagattaatctcttgaggtcctggatgcctcatcccttagtttcaacaccagattgaaatggtttgccatctgcttcgtatgtggcgttttcttttctattcttggaactggattgctgtggcttccgggcggcataaatctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcatacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcatatgtgtcataatatacttttcccaagataagatttttaatcactgccagttgtaattatttttagccaatttttaaatcttttcaaagcagctttgaaatgtgaatatttaaaggtagacctgtgctgcaagataattaaacttttttgcttttaaaaatgtctgcatttttaagattttttttactttaaatgtgaaacttattttaagctaaaaattgcttattatatgtaataaaaataatatataaatctttacaattttgaaataaacccatccttgg

SEQ ID NO: 212 - DNA, 4130 bp, Homo sapiens
  misc_feature: Incyte ID No: 021524.2c
gtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcaggtttttgttgtacctgtatccagatcttcttttcactgttctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaagcctcctgtatgaagccagaagcacaagtgccttcagagggcagttgattccagtccagttgcctccctagcttgtgtgtggcctgcctccaccatagcagggactagggagggaggcagggaacgttttttcttttctacatcttcacaggttcggctgggggcagctgataggcctaaggccataccttactatttaagatactctgatcgcacaactgcagagacagggttccctcactgctagtcagcttcttttggaaactggacaggccattgccacctgcactttgaagaagtgagcaaagacgtggccacatttctaataagttgaaatggtctttctcccttcctcagagagcaaccagcttctttttttttaaaagtcctttctatctgttggatacaacagtgtgcttttggtgcacattttttagcaatagttgtgaattaatggcaaagaaaaaaaaaattatttaccagccctcagttgtgtttgcccgaggggcctttgagcaaagaaatgggttttgctgggtcattttgccctgtgtgctaagccttgggtggctgcattcccctcctgtcatagatctgacccccagcatgattgtatttctttcccctccagtcaaaccgtaatacagtttccagaaaattcgacagtctgcaatgccaaaagggtaaaaatctgtatttcacagttgtatagaataaaggctttagttaaaatatttcaaagtgtagtacacatttattttcatttgttattttctttcatagcagattacagagaaagaaagaaacctctggtttcatgttctccctggaaatattagcattgatacccattttatcctccaacttatgggggaagggaaagtaaaagtgagggagggaagagccagaacctttgggtgagggcaactttgggtcagactgccaggctacagagttaagggaagctggccccagaacagtcctgtggcgattctgttctacttcctgcattccagcagacttgacactgggctcccagacgatccaggacacaatgcctcactgttatgcacacgtatcagctgctctggtaggcttgacaagggtttgctttaaatgaagggtttgctaatttgggaccctccctccatatagttggcctgtgccccccagagcagacattccttgtcctgcatacctgacacagcttgtgagttccctgcatgtacaccagcattacaaatgatcctgtaaaggtgagactttcaactaggcacaagctagaagacgaggccagagcagctttcatagtaattagcagtgtgggaactgagggtccagtcaacacagcagaggacttcaggtgatgaggggccgtccccaggtggagtgcagggcctaacctagccttaacctccgaaggcacctggggtggggagaacagcttcctcccctacaacaggaaagaacaaaagggtctttacctactcttaatctaatcccctaattcccccttggggttgggaaccgtgcgtggatagacctagtcaggtagactggctttgagaaattgcttagggtgttgaacttaaatttgtgacttttattcactattggggctgggtagatgccttgtatatttagaagagatcactgtttaagtttgggagctaacaggagttgccactggggatacaggtctgtggcatgtagtccctgaggaagaagaaatattgtggtctgggcacaaatgggtctctgctgaagggcctagaatttccaacgcacctccctccaggagatgggggcaagtacactgcctctctctccctcctgtgactagcatggtgatcagcctgagccaagtgtagcattgtagcctagggacaaggacacatgacagaggactcagtgtttgggacttgaaagggggtggtcccagggctccagggtcccttccagtacagatggggtgggctgagctgtgcaggaagaatcaaagcgaccaggccaacactggacagcaaccccttccttcctcacctcatcttcacactggattatgaccagaccctgctgcctcctgggaagccccagtgaccagagcaggaccaagcactggacctgagggtacacggccaaaagatatcctcccacaaggcccatggccccctctcaccacccactgaggcctcatgtcccaccaaagcagcaaggaatcctgaccgcatagtgcagcccgggctgcctgcccacatctgggcctcatgaaatgtcatcatgggccttgtcacagccccagggtgttattctgtggtagagatctgggcctggctgtccagcccctcagcctccgtcccagtatctaggccctctgtgcttgctggttcctcctcagcctgagcttcaagcagctcggcggacagcccatcttctggtgaggctgcagaggtgagactgtcaggaagagtcagctgaggcaggtggtccgcctgggcttgggcacctgggctgtcccaggaaggagacctcaaactctgacccagaccatgtagcctcaccaccccgctcatgagaactgctgctggagcagatgtcctctggccctgaggttgagacagctgtggtggtcagttctgtggaagagggcaggctgggccacacactggcattgctgttgtccaagagagaaattcccgacacgtccaggaagcctgggtccataactcgctgcactggaggtgggggctgaagaggagtctccatgaaatggggaagtccatcagggtctggagcactgtggctgggactcccaggcccaggaaggggatcctccatggaggagccaggtgcctgcagcagggcctccatgtagtcactctgcctggaacctgtctccagggaaggagagtcctcgggggtgggtccaggtggtagagcatcaggtggtggggcaccaagtggtagagcagaaggtggtggggtgccaggtggcttcttgtggtagctggggggctgagttgggatccggtgtagatacccatagccaatgccacatcccagactgccctctccaccccaggctgcgttgggagttacagtcacctcccggcaggagtctgacttggagttatacaccatcagcttcaagggcttcccctcatgagactcgatgagcgtaaagaagtcctcggactgtgagaaacgcatagcacctgaggcctgcttccagggctaaagcctcaacaaaaccagacacttctcatggacagcacccttctcttcacaccacatccagagggtctggggaggggcaaattgcgggttcctcacctcctggagaatctggtccgaaccaaccacatagtctgtgtaggggcgcaggccgacaagggcagcaggtgaagatggttccacatcctggggaaagaaccgcaaaccactggccatgctactagaggtggggttgggggatgggaaaggcaggggaactgcctc

SEQ ID NO: 213 - DNA, 3094 bp, Homo sapiens
  misc_feature: Incyte ID No: 021524.9
  unsure 3017, 3021: a, t, c, g, or other
tggcggcccatcaccggcagaacacagcagggcggaggaaagtgcaggtttcctatgttattcgagatgaagtggagaagtacaaccgaaatggagtcaatgctctgcagctggatccagcactaaatagacttttcacagccggtcgagactctatcataagaatatggagtgtcaatcagcacaagcaagatccatatatagcatctatggaacaccatactgattgggtaaacgacattgtactctgttgtaatgggaaaacattaatatctgcttcttctgacacgacagtaaaagtatggaatgcacacaagggattttgcatgtcaacattaaggacacataaggattacgtaaaggccttagcatatgccaaggataaagaactagtagcatcagctgggttggacagacaaatattcctttgggatgtgaatactctaacagcattgactgcctcaaataacactgtcacaacttcttctttaagtggaaacaaagattccatttatagcctggccatgaatcaactgggaacaatcattgtatcagggtccactgaaaaggtgttacgggtatgggatccaagaacatgtgcaaaactaatgaagcttaaagggcacacggataatgtgaaggcattgctattaaacagagatggcacgcaatgcctgtcaggcagttctgatgggacaattcgcctttggtcccttggccagcagagatgtatagcaacataccgagtccatgatgaaggtgtttgggcgctgcaagtcaatgatgccttcacacatgtgtattctggtggaagggacaggaagatttattgtacagacctaagaaaccctgacattcgggtgctaatttgtgaagaaaaagcaccagttctcaagatggagcttgatagatcagctgatcctcctcctgcaatttgggttgcaacaactaagtctacagtaaataaatggactttgaaaggaattcataattttagagcctctggagattatgacaatgactgtacaaatcctataacacctctttgtacacaacctgaccaggttattaaagggggtgctagtattattcagtgccacattcttaatgataagagacatatattaaccaaagataccaataataatgtggcatattgggatgtattgaaggcatgtaaagttgaagatctgggcaaagtggattttgaagatgaaattaagaaaagatttaaaatggtgtatgtgccaaattggttctcagtagacttaaaaacagggatgttaactattactttggatgaaagtgattgttttgctgcctgggtttctgcaaaagatgctggtttcagcagccctgatgggtcagatccaaaattgaatttaggaggacttttactccaagcactcctggaatattggcctagaacacatgtgaatccaatggatgaagaggaaaatgaagtaaaccatgtaaatggggagcaggagaaccgagtgcagaagggaaatggatattttcaagtgcccccacatacacccgtgatctttggtgaagctggaggtcgcacactgttcaggctgctctgccgagattccgggggtgagactgagtctatgcttcttaatgaaacagtgccacaatgggtaattgacatcactgtggataaaaatatgcccaaattcaacaaaattcctttctacctccaacctcatgcatcttcaggagcaaaaaccttaaaaaaagatagactctctgctagtgacatgctccaagtccgaaaagttatggaacatgtttatgaaaaaattatcaacttggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccccaagagtagtcctaggaagcccactgatccccaacgggagcaagacttctaacggctgattggtatggaccgagattatctttcaattgaagtgactaatcgagatgtaatatagaaaccagtctccatgtgtagattaagctgtccccagggaagcagagtgcaagagcagaagagccccaagcagactatgtctttcaagatgtacagaagactgacaacaggccagtgcagactttgcttcctccttttgtttcaaaggaccttatctacccattaacacttgttagagacacctcagtcgggccacaactgtctctgtttcaactttaagcccacacactctgtagcttttctaaaacagtacattccattcatgcagtagatatgaaggctttttccaagtttgtcatataaagtaatcaaattgttttcaccgtttaagacagttatttttaatgggaatttgctgttgcacaatttgagaaccagcccatttcataataaaagattaatgttgggcttgttgttaatattgcatctcagatgtgttcttgtaggaagatctgttgaaattccaggtgctggatcatagcacttggactgttgggccggagtttgtgcagcccatgcctagcgatgctgcacctcccatgatgtcctggctttgtggcaaccccagggaggtgcagcagtttcactccttcctccactgtgtccagttttatttacacaaagcgagctgagaccacaggttcttgctctggatgagcagcatgacaccatcaaaatttaagaccatgatgaaatttcagtttcattcaaatgttacctaaaatttatggtgtcagaataaagggagatcatagtgagttaatttgatattcatatcctggaagtatacatatttgtttttccaaagttttatatgcnggtntttgttgtacctgtatccagatcttcttttcactgttctaacaatctaacactttcatagaatcatttggatc

SEQ ID NO: 214 - DNA, 653 bp, Homo sapiens
  misc_feature: Incyte ID No: 253987.16
gggctgaacacccaggcaaggatgctgcgggaccctcggagttatcagctggaggtacagaccaagtttcctccctggcgccggccagtctgcggacggcccccgcctcggcacgctcggcggaaactgactgctccttggtcttctttcctcccccgcccagaacgcaggtgctggcgcccgttctgcctgggaccccgggaacctctcctgccggaagccggacggcagggatgggccccaacttcgccctgcccacttgacttcaccaaatcccttcctggagactgaacctggtgctcaggagcgaaggactgtgaacttgtggcctgaagagccagagctagctctggccaccagctgggcgacgtcaccctgctcccaccccacccccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtacctttttttacaggaaggtgactttctgtaacaatgcgatgtatattaaactttttataaaagttaacattttgcataataaacgatttttaaacacttgtgt

SEQ ID NO: 215 - DNA, 3931 bp, Homo sapiens
  misc_feature: Incyte ID No: 344553.1
  unsure 3210-3228: a, t, c, g, or other
actccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccagtgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtggcgcactgctggcagctgctatgcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggnnnnnnnnnnnnnnnnnnnggttggacccaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtccttattttccactaaacacagacacatgaaatgaaagtttagctagcccactatttgttgtaaattgaaaacgaagtgtgataaaataaatatgtagaaatcaaaaaaaa

SEQ ID NO: 216 - DNA, 5228 bp, Homo sapiens
  misc_feature: Incyte ID No: 410785.1
  unsure 4929, 4935, 4940, 4945, 4974, 4993: a, t, c, g, or other
cacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcttgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgtttacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttaaactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttatattgttccccttctacaactttttccttgcagagatacatgtgagttgacaagaaacattaaagggaaataagaagaagctgataaagctttataggaggaccaaagaactagcttactataataaaaaaattttaagtcttcaagggtatacatcataataaaaaataaaattgacagtaattaattaaatttaatcccagggaaattagatgtgaatttgaacacctaactttccatgtactctctcatttttgtggaagtgtttctatactctaatgcctttacaaatgtgatttttctcttagctcgtttgaagtatgagaattagagtttttggtctcgcattcacctgctacatctaggattgcccactgtcatgactcccagggaaaaggtcctatcttagcttcctcctccctactttcctctacatggtcagcactgtaatgtagctaagatatagtaaggcattgctccctccccctacacttcaaggagttcacagtctaatggggagttcaggaaggccagagtattaatatccccatctgtgtcttttgccttccatgaacctgggttttgagccctctcttgtaaaatgggcacagtaatattacctacctcagggagttgtgaggattaaacatgaagtgctaagcatagtgcctggtacaaagacagtactcaataagtgctacctaaaactagtattcatagcaatactgttaggataaagaattatcatatatgagatagttccaaatttttgtttttttaaaaaaaaaagagttttataagttcaagataatattttcttacttcaaagaaacaatctcacaacgagggaatggtaagaatcaggagagattactaacctggcagaggagctatcacaatcacaaaggtggtttttccagggcacggctcatccattacactccagatgtgctgacccctgccatttccccaaatgtgggaaacccaactgcacagtttgtagtagtgggtgactgtgttcatgcgctcccctgaaaacaacaacaacaacaaagaatcagaagagatactaggctatctaattcctaaatccaaacctgatatttctaagtaagattataagaatttttattgcattttctgaatttgcttttgcataagttatgttatttttacagggtctatattactattatttcttagaataatactaattataaaacaaaattctgtatatcacatttaaatgtaatttaatagaattataatcacaagacaagaccaaactttgtgtgataatcctcagtaattgcganaggggnatatncatgnaggccagcatacatgcataaactacttcntattgctaggctaattgtnccatatgtagcaaatacagcagttcagcaatatcttgtgcttacagggtcctaagcagaggtgatgagtcaagtgtaaatatatatatatatttttttatttttcatggcaattgtatattagtaacctggggagaaaaggtttattgacaaccactctgatccatctgctgctatttttactgctaatttggtgcacattaaaaagaatgatcatgaaaagatattactttgag

SEQ ID NO: 217 - DNA, 519 bp, Homo sapiens
  misc_feature: Incyte ID No: 237623.6
gcgtcccggagcccacggtggtcatggctgccagagcgctctgcatgctggggctggtcctggccttgctgtcctccagctctgctgaggagtacgtgggcctgtcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagaaaaa

SEQ ID NO: 218 - DNA, 392 bp, Homo sapiens
  misc_feature: Incyte ID No: 076047.1
gattgtggtcttgatattaaattaagtgcacctaaagaaaaaaaaattgaataaagcaattctacatgtactaatgtggaatagctgccaagatacattaagtgaaaaaaatcaaagagcaagacagtgtaattttgcatagtaccatttttattttgaaagattatattaatgcttggtatgcgtaaaatagctctggaaggattcaagaaagatctgcttggttacctctgagaaaaggagttagatgttggaaacaggggtgggaggaaaattgtttatattgcataatgtcttttaacgtttggattttgtgttgtggctaaggtagtacctattagaaataaataaaattaggtaattttaaaaataaagaaatgctgtaaattttg

SEQ ID NO: 219 - DNA, 1811 bp, Homo sapiens
  misc_feature: Incyte ID No: 1099500.15
cgtcccatcatcttcaggttatctttgattttgggagtttacatagtaccagttttgtccttggaatgactcagtgcatttggtttatatttttttcagacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggctagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccacccctgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctacttttcgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaag

SEQ ID NO: 220 - DNA, 3347 bp, Homo sapiens
  misc_feature: Incyte ID No: 1099500.18
ggctcctcccccgggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaatatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaaggaaaaaaaaaaaaaagcgccgctcgcgatctagaac

SEQ ID NO: 221 - DNA, 4170 bp, Homo sapiens
  misc_feature: Incyte ID No: 2278688CB1
gctcccccggtcgctctcctccggcggtcgcccgcgctcggtggatgtggcttgcagctgccgccccctccctcgctcgccgcctgctcttcctcggccctccgcctcctcccctcctccttctcgtcttcagccgctcctctcgccgccgcctccacagcctgggcctcgccgcgatgccggagaagaggcccttcgagcggctgcctgccgatgtctcccccatcaactgcagcctttgcctcaagcccgacttgctggacttcaccttcgagggcaagctggaggccgccgcccaggtgaggcaggcgactaatcagattgtgatgaattgtgctgatattgatattattacagcttcatatgcaccagaaggagatgaagaaatacatgctacaggatttaactatcagaatgaagatgaaaaagtcaccttgtctttccctagtactctgcaaacaggtacgggaaccttaaagatagattttgttggagagctgaatgacaaaatgaaaggtttctatagaagtaaatatactaccccttctggagaggtgcgctatgctgctgtaacacagtttgaggctactgatgcccgaagggcttttccttgctgggatgagcctgctatcaaagcaacttttgatatctcattggttgttcctaaagacagagtagctttatcaaacatgaatgtaattgaccggaaaccataccctgatgatgaaaatttagtggaagtgaagtttgcccgcacacctgttatgtctacatatctggtggcatttgttgtgggtgaatatgactttgtagaaacaaggtcaaaagatggtgtgtgtgtccgtgtttacactcctgttggcaaagcagaacaaggaaaatttgcgttagaggttgctgctaaaaccttgcctttttataaggactacttcaatgttccttatcctctacctaaaattgatctcattgctattgcagactttgcagctggtgccatggagaactggggccttgttacttatagggagactgcattgcttattgatccaaaaaattcctgttcttcatcccgccagtgggttgctctggttgtgggacatgaactcgcccatcaatggtttggaaatcttgttactatggaatggtggactcatctttggttaaatgaaggttttgcatcctggattgaatatctgtgtgtagaccactgcttcccagagtatgatatttggactcagtttgtttctgctgattacacccgtgcccaggagcttgacgccttagataacagccatcctattgaagtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccacagaggatctctgggaaagtttagaaaatgctagtggtaaacctatagcagctgtgatgaatacctggaccaaacaaatgggatttcccctcatttatgtggaagctgaacaggtagaagatgacagattattgaggttgtcccaaaagaagttctgtgctggtgggtcatatgttggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaagttaaacttaggaacagttgggttttatcggacccagtacagctctgccatgctggaaagtttattaccaggcattcgtgacctttctctgccccctgtggatcgacttggattacagaatgacctcttctccttggctcgagctggaatcattagcactgtagaggttctaaaagtcatggaggcttttgtgaatgagcccaattatactgtatggagcgacctgagctgtaacctggggattctctcaactctcttgtcccacacagacttctatgaggaaatccaggagtttgtgaaagatgtcttttcacctataggggagagactgggctgggaccccaaacctggagaaggtcatctcgatgcactcctgaggggcttggttctgggaaaactaggaaaagcaggacataaggcaacgttagaagaagcccgtcgtcggtttaaggaccacgtggaaggaaaacagattctctccgctgatctgaggagtcctgtctatctgactgttttgaagcatggtgatggcactactttagatattatgttaaaacttcataaacaagcagatatgcaagaagagaaaaaccgaatcgaaagagtccttggcgctactcttttgcctgacctgattcaaaaagtcctcacgtttgcactttcagaagaggtacgtccacaggacactgtatcggtaattggtggagtagctggaggcagcaagcatggtaggaaagctgcttggaaattcataaaggacaactgggaagaactttataaccgataccagggaggattcttaatatccagactaataaagctatcagttgagggatttgcagttgataaaatggctggagaggttaaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctcgttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctactaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaaaaaaaaaaa

SEQ ID NO: 222 - protein, 919 aa, Homo sapiens
  misc_feature: Incyte ID No: 2278688CD1
MWLAAAAPSLARRLLFLGPPPPPLLLLVFSRSSRRRLHSLGLAAMPEKRPFERLPADVSPINCSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDFVETRSKDGVCVRVYTPVGKAEQGKFALEVAAKTLPFYKDYFNVPYPLPKIDLIAIADFAAGAMENWGLVTYRETALLIDPKNSCSSSRQWVALVVGHELAHQWFGNLVTMEWWTHLWLNEGFASWIEYLCVDHCFPEYDIWTQFVSADYTRAQELDALDNSHPIEVSVGHPSEVDEIFDAISYSKGASVIRMLHDYIGDKDFKKGMNMYLTKFQQKNAATEDLWESLENASGKPIAAVMNTWTKQMGFPLIYVEAEQVEDDRLLRLSQKKFCAGGSYVGEDCPQWMVPITISTSEDPNQAKLKILMDKPEMNVVLKNVKPDQWVKLNLGTVGFYRTQYSSAMLESLLPGIRDLSLPPVDRLGLQNDLFSLARAGIISTVEVLKVMEAFVNEPNYTVWSDLSCNLGILSTLLSHTDFYEEIQEFVKDVFSPIGERLGWDPKPGEGHLDALLRGLVLGKLGKAGHKATLEEARRRFKDHVEGKQILSADLRSPVYLTVLKHGDGTTLDIMLKLHKQADMQEEKNRIERVLGATLLPDLIQKVLTFALSEEVRPQDTVSVIGGVAGGSKHGRKAAWKFIKDNWEELYNRYQGGFLISRLIKLSVEGFAVDKMAGEVKAFFESHPAPSAERTIQQCCENILLNAAWLKRDAESIHQYLLQRKASPPTV

SEQ ID NO: 223 - DNA, 8412 bp, Homo sapiens
  misc_feature: Incyte ID No: 380283.1
  unsure 4053-4099, 8362, 8373, 8382, 8389, 8399, 8406-8407: a, t, c, g, or other
gcgggaggagaggtttgggaggcgcaggagatgtccaccctgggctggtggcgccgccgggcgccgggcgccatgagggtgcgctaggcggctgttcgtgcccgaggctgcgcagcactgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggagtgcagcttgctgaagacgatggccactcccacatgacgcagggccactcatcaagatccaagagaagtgcctacccaagcaccagtcgaggtctaaaaactatgcctgaagccaaaaaatcaacccaccggcgggggatttgtgaagatgaatcttcccacggagtgataatggaaaaattcatcaaggatgtgtcacgcagttccaaatcgggaagagcaagggagtcaagcgaccggtcacagagattccccagaatgtcagatgataactggaaggacatttcattgaacaagagggagtcagtgatccagcagcgggtttatgaagggaatgcatttaggggaggctttaggtttaattcaacccttgtttccagaaagagagttcttgaaagaaagaggcgctatcattttgacacagatgggaagggctcgattcacgatcaaaaaggctgtcccaggaagaagccctttgaatgtggtagtgagatgagaaaagccatgagcgtgagcagcctgagcagcctcagctccccctcctttaccgagtcacagccaattgattttggggcaatgccatatgtatgtgatgagtgtgggaggtcgttcagtgtcatctcagaatttgttgagcaccagatcatgcatactagagagaacctctatgagtatggtgagtcctttatccacagtgtggctgtcagtgaagttcagaaaagtcaggttggagggaaacgttttgaatgtaaggactgtggagagaccttcaataagagtgccgccttggctgaacatcggaagattcatgctagaggttatcttgtggaatgtaagaatcaggaatgtgaggaagccttcatgcctagccccacctttagtgagcttcagaaaatatatggcaaagacaaattctacgagtgcagggtgtgtaaggaaaccttccttcatagttctgccctgattgagcaccagaaaatccactttggggatgacaaagataatgagcgtgaacatgaacgtgaacgtgaacgtgagcgcggggaaacctttaggcccagcccagcccttaatgagtttcagaaaatgtatggtaaagagaaaatgtacgaatgtaaggtgtgtggggagactttccttcatagctcatccctgaaagaacatcagaaaatccatactagagggaacccatttgaaaacaagggtaaagtgtgtgaggaaacctttattcctggtcagtcccttaaaaggcgtcagaaaacttacaataaggagaagctctgtgactttacagatggccgggatgccttcatgcaaagctcagagctcagtgagcatcagaaaattcattctcgaaagaacctctttgaaggcagagggtatgagaaatctgtcattcatagtgggccattcactgaatctcagaagagtcatactataacaagacctcttgaaagtgatgaggacgaaaaggcgttcaccattagctctaacccctatgaaaaccagaagattcccactaaggaaaatgtctatgaggcaaaatcatatgagaggtctgttattcatagcttagcctctgtggaagctcagaaaagtcacagtgtagcagggcccagtaaaccaaaagtaatggcagagtctaccattcagagcttcgatgctatcaaccatcagagagttcgtgctggagggaacacctctgaaggaagggaatacagtaggtctgttatccatagcttagtggcttccaaacctccaagaagtcacaatggaaatgaattggtggaatctaatgagaagggagaatcctccatttatatctcagaccttaatgataagcgacagaagattcctgccagagagaacccttgtgaagggggcagtaagaatcgcaactatgaagactctgtcatacagagtgtattccgtgccaaacctcagaaaagtgttcctggagagggatctggtgagtttaagaaggatggcgaattctctgttcccagctcaaatgtccgtgaataccagaaggctcgtgctaaaaagaaatacattgagcataggagcaatgagacctctgtaattcactctctgccttttggtgaacaaacatttcgccctcgagggatgctctatgaatgtcaggagtgtggggagtgctttgctcatagctctgacctcactgagcaccagaagattcatgatagggagaagccctctggaagcagaaactatgaatggtctgtcattcgcagcttggcccctactgaccctcaaacaagttacgcccaagagcagtatgctaaagagcaagcgcggaacaaatgtaaggacttcagacaattttttgctaccagcgaagacctcaacacaaaccagaaaatctatgaccaagagaagtctcatggcgaggagtctcaaggcgagaatactgatggggaggagacccacagcgaggagacccatggtcaggagacaattgaagaccctgtcattcaaggctcagacatggaagaccctcagaaggatgaccctgatgacaaaatctatgaatgtgaggactgtggcctgggctttgtggatctcacagacctcacagaccatcagaaagtccacagcaggaagtgcctggttgacagtcgggagtacacacattctgtaattcacacccattccatcagcgagtatcagagagattacactggagagcagctgtatgaatgtccaaagtgtggggaatcttttattcatagctcattccttttcgagcatcagagaatccatgaacaagaccagttgtattccatgaaggggtgtgatgatggttttattgccctcttgcccatgaagccacggaggaatcgtgctgcagagaggaatcctgctcttgctgggtcggccattcgatgccttttgtgtggacaaggcttcattcatagctctgcccttaatgagcatatgagacttcatagggaagatgatttactggagcagagccagatggctgaggaagctatcattccaggcttagccctcactgagtttcagagaagtcagaccgaagagagactctttgaatgtgcagtctgtggagaatctttcgtcaacccagcagaacttgcagatcacgtaactgttcataagaatgagccctatgagtacgggtcctcctatactcacacctcatttcttactgagcccctcaaaggagctataccattctatgaatgcaaggattgtggtaagtcctttattcatagcacagtcctcactaaacataaggagcttcatctgnnnnnnnnnnnnnnnnnnnnnnnnnnnnnnnnnnnnnnnnnnnnnnnccaggaagttgaagccaatgtccatgttccacaagtagttctgaggattcagggcttaaacgtagaggctgctgagccagaagtggaggctgccgagccagaagtggaggctgctgagccagaagtggaggctgctgagccaaacggagaggctgaagggccagatggagaggctgcagagcccattggagaggctggacagccaaatggagaggccgagcagccaaatggggatgctgatgagccagatggtgcaggtattgaagacccagaagaaagagctgaagagccagagggaaaagctgaagagccagagggagatgccgacgagcctgacggtgtgggaattgaagacccagaagaaggtgaagatcaagagattcaggtagaagaaccatactatgactgccatgaatgcacagaaaccttcacttccagcacagcattcagtgaacacctgaaaactcatgccagcatgatcatatttgagcctgcaaatgcctttggggagtgctcaggctacatcgaacgtgccagcaccagcacaggtggtgccaatcaagctgatgagaagtacttcaaatgtgacgtctgtgggcagctcttcaatgaccgcctgtccctcgccagacaccagaatacccacactggctgagggcatggggtaaaggttagaaaaccttcacctaggacttgacccttaccaaaccacagagaatccaaaccaatccatgataatgtcagtaggagacttaaccttagtgtgttacacacctgacttaacatctctaaactcagattgaaaagagaccgaatgtgcagattccacagtcttaagctttccccttcagatgtcagtgtctgcatgtgggaaagccatagcacacatcttacctttccaagtaatcagattgagaaaaccctatgagtattccagactacagagtttgcccaaatcaactgtaaatgacacttgtgtaacgtatatatagtgtttcatgaggtgtatataaaatagcaaattatgacagaacagtgatcacatatatttggatttatatgatatacagttacagtttactctgcagaggtaccttacctggtattctttgaatttttttacaatgggaggaggaagagagcaacaaatttgattatatttttaagtgtcttagatcctgagaaagatttattgtgcattatttgaaccctgtcaatatctttttgagtaattgttttgtttcttacccttaaatagtcttgtgaagctgtaggcatgatagataacatggcttttactccttactgtttgaaaagataagtactttagcttctttctgcagccatttcatctgcaccaacactttggaacctaatactgtgtaaggctttacaatatacggattggctttttgtgacccagattgattggttgccacatgttatgtttgttgaagtggttctcatgcaaaaatattacacatttgtgttctgggtttttttttttttttaaccaactcaatatgtgtttgatgatagtgaattgataaaacccgaagcttttccctgtaaatcttacatctttgcctttaaagaatgggttacaaccatcactagatcacagtagtgcctaatgaaggttgagaaccgtaggagaggctctcatgctgtaaataatgttgcaggctaataacctttcatcacttcctttgtgcgcttcctgccttaagtgacaagtagcaacatggcttgggtcccctgtgcagcatcagcttatgctgccacaagtcagtttgcaccctaggtgcccaggagctagtatccttagatctttctatcgctaacttaattctcttcgttatttatctgaccctctaactccatgtctaacttgcattaaaaaaaaaaaaattctttacagtcaacccaagcttaacatggactcaggttccccagcagccttaatttgttttgttaacatctgttccttctttttcagctctcctagagtatttctgagtgttgtgttcatctaatcttagtattcttttaattacaaattgacctcacagcttgaggtttcttgtgtcctattctgtggactacctgtgctcctttgcttcccctcccctcgcataataactatattaagaaattttttttggccttgagttggctggaaaaaaaatataaaatttaaaaaatttaaaaaaaaagatttgcaaaatgtaagtgtagatcatttgaacaagcaaaattaaagtacccactgggggaaatgtgtctgaatcttactcttctggatctgcaggattagggcttggaagtatgtcaaagatggagggagtgtcaaagtttaggaagattgtagagctgagagcaagaagcagaaatgagtgagtcaaagaagggagtcctaatacatcaccagatctaggaggggagaggagacagacagaagaaaacaccagaggcaagaactgtagaaggccaggtttctgagaatgaattgagcggggtgtcctgagcagtttggaaaaggagtttttgatggtatggtgtaggtgagggctggctgcataggaaggactgaggttggaacggacatcgggaaagctgaggggcagtgaggtttactacatgggaaaaggactcttgaaacgagaatcagtgttgatgtcggggtgaactttgtgggtacattacttggtgttaacattgttggcagtggtagccccttttcagaaagcaacttgctgtaagtcagggtgtccgttccaaccttcagctagtgaaaaggtagtaacaaatggtaaacaagagaatgattgtttaaacctatctgtggacacttaatgcaactgtttaaaaatgataatcacgagttatgtagcaacgtggaaatatatttacagaacattaagtggagaaagcaggacacgaaagtatatttatactacagttataactcaacagttcatttatatgctgttcatttaacagttcatttaaacagttcattataactgtttaaaaatatatatgcttatagtcaaaagctgttgtggtgttgttgttgtaggcttatagttgagcattattttcttaaatttcttgaatgttctttatggtagtgttactaaaaagtttatgatcacattttcattgtgaacataatttgaactcattatcacacacttggaaaatacagaaaagtggaggaaaaaaaaatcatatccccaccatccaaagacatatactctcctcttatcttgttcattcttgtttctgtgcacaggtttatgattataactgtgtcaaaatgtatattcaaaatagctgttacattacctttgtggaattatggttaaatactttcactttaattttttcaaatgttccctataataatgtcctgataacagtgtattatgtgtgtctccattggtgtgcataatacatacccagaggaaaaattagaaaataaagtaaattattttaaaaaattacctatattcccaacacctaacaactactgctaacatcttgatctgtttcctctatcttgtttcagtgcacacgcttgtgataacagtgttaaatatgtgtgcataaagtcttaaatgaaaagatgtggaaaataactaaaatagtgttgtcattgtgggaatttggttaaatattttgtctcaaattccttaaataatctttggtgttttggtaataaattttatgtatgtattttccattacaaatataatacatactcatacaaaactttggaaattcagtaaagaaaattcacacatattcccaacacccaacaacaattaactgttaacatcttgatctgtgcactagtctgtgattattagggtgttagtgataagtatgcataaatgtcaaagatgggaagaaagatgaaaaacaagaaatagttgtgtggttgttgtgggattatggttattttgtttcggtttccttgaaaggtcatcattctagtgttttggtagtccacctttactacatatatttccattatatatgaaatgtgttcattatagaaactttgaagttacagaaatgtagaagagaaactcacccatgttttcaccatccaaagagtgtggttaacatcttgatatattttcttcatcttgtttctgtgcacaggtttttggtttgttaatatggttgtggtcattctatctgtaatagtgtcaacaataaaaataaagttaaaaataaatatttaaaaaaaanaagaaaagaanaaaaaaaanaaaaaanaaaaaagaanaaaaaannaaaga

SEQ ID NO: 224 - DNA, 990 bp, Homo sapiens
  misc_feature: Incyte ID No: 1720847CB1
acagagactggcacaggacctcttcattgcaggaagatggtagtgtaggcaggtaacattgagctcttttcaaaaaaggagagctcttcttcaagataaggaagtggtagttatggtggtaacccccggctatcagtccggatggttgccacccctcctgctgtaggatggaagcagccatggagtgggagggaggcgcaataagacacccctccacagagcttggcatcatgggaagctggttctacctcttcctggctcctttgtttaaaggcctggctgggagccttccttttgggtgtctttctcttctccaaccaacagaaaagactgctcttcaaaggtggagggtcttcatgaaacacagctgccaggagcccaggcacagggctgggggcctggaaaaaggagggcacacaggaggagggaggagctggtagggagatgctggctttacctaaggtctcgaaacaaggagggcagaataggcagaggcctctccgttccaggcccatttttgacagatggcgggacggaaatgcaatagaccagcctgcaagaaagacatgtgttttgatgacaggcagtgtggccgggtggaacaagcacaggccttggaatccaatggactgaatcagaaccctaggcctgccatctgtcagccgggtgacctgggtcaattttagcctctaaaagcctcagtctccttatctgcaaaatgaggcttgtgatacctgttttgaagggttgctgagaaaattaaagataagggtatccaaaatagtctacggccataccaccctgaacgtgcctaatctcgtaagctaagcagggtcaggcctggttagtacctggatggggagagtatggaaaacatacctgcccgcagttggagttggactctgtcttaacagtagcgtggcacacagaaggcactcagtaaatacttgttgaataaatgaagtagcgatttggtgtgaaaaaaaaaaa

SEQ ID NO: 225 - protein, 90 aa, Homo sapiens [sequence omitted]

SEQ ID NO: 226 - DNA, 201 bp, Homo sapiens
  misc_feature: Incyte ID No: 333776.1c
  unsure 27, 43: a, t, c, g, or other
aaagatgaaaaaaaggcaaggagaganaaaggtaaggagcaantctcccttgctctgcaatacaatgaaattcaaccacttaaaaaaaaaataaatataccatgcggccatcatttactgaaagctaccttcttcaagccctaggttgttttgttttagacatacacattccatatatgtgtgtgtatacacacacacacg

SEQ ID NO: 227 - DNA, 1278 bp, Homo sapiens
  misc_feature: Incyte ID No: 3478236CB1
aagagcttatgacgttcgcatgcaacgcgtacgtaagcctcggaattccggcttggaggccacacctgggtgccagcgccccagaggtcccgggacagcccgaggcgccgcgcccgccgccccgagctccccaagccttcgagagcggcgcacactcccggtctccactcgctcttccaacacccgctcgttttggcggcagctcgtgtcccagagaccgagttgccccagagaccgagacgccgccgctgcgaaggaccaatgagagccccgctgctaccgccggcgccggtggtgctgtcgctcttgatactcggctcaggccattatgctgctggattggacctcaatgacacctactctgggaagcgtgaaccattttctggggaccacagtgctgatggatttgaggttacctcaagaagtgagatgtcttcagggagtgagatttcccctgtgagtgaaatgccttctagtagtgaaccgtcctcgggagccgactatgactactcagaagagtatgataacgaaccacaaatacctggctatattgtcgatgattcagtcagagttgaacaggtagttaagcccccccaaaacaagacggaaagtgaaaatacttcagataaacccaaaagaaagaaaaagggaggcaaaaatggaaaaaatagaagaaacagaaagaagaaaaatccatgtaatgcagaatttcaaaatttctgcattcacggagaatgcaaatatatagagcacctggaagcagtaacatgcaaatgtcagcaagaatatttcggtgaacggtgtggggaaaagtccatgaaaactcacagcatgattgacagtagtttatcaaaaattgcattagcagccatagctgcctttatgtctgctgtgatcctcacagctgttgctgttattacagtccagcttagaagacaatacgtcaggaaatatgaaggagaagctgaggaacgaaagaaacttcgacaagagaatggaaatgtacatgctatagcataactgaagataaaattacaggatatcacattggagtcactgccaagtcatagccataaatgatgagtcggtcctctttccagtggatcataagacaatggaccctttttgttatgatggttttaaactttcaattgtcactttttatgctatttctgtatataaaggtgcacgaaggtaaaaagtattttttcaagttgtaaataatttatttaatatttaatggaagtgtatttattttacagctcattaaactttttt

SEQ ID NO: 228 - protein, 252 aa, Homo sapiens
  misc_feature: Incyte ID No: 3478236CD1
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 229 - DNA, 5060 bp, Homo sapiens
  misc_feature: Incyte ID No: 147541.17
  unsure 1806-1826: a, t, c, g, or other
atttgggtttttaaagggaaggcgtccgcgcggcggccattttgtcttgtcggctcctgtgtgtaggagggatttcggcctgagagcgggccgaggagattggcgacggtgtcgcccgtgcttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtttgtaaatattatctctgtggtttttgtcctgcggaattgttcacaaatacacgttctgatcttggtccgtgtgaaaaaattcatgatgaaaatctacgaaaacagtatgagaagagctctcgtttcatgaaagttggctatgagagagattttttgcgatacttacagagcttacttgcagaagtagaacgtaggatcagacgaggccatgctcgtttggcattatctcaaaaccagcagtcttctggggccgctggcccaacaggcaaaaatgaagaaaaaattcaggttctaacagacaaaattgatgtacttctgcaacagattgaagaattagggtctgaaggaaaagtagaagaagcccaggggatgatgaaattagttgagcaattaaaagaagagagagaactgctaaggtccacaacgtcgacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcnnnnnnnnnnnnnnnnnnnnnggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattaattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatccttctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcaactgtataaaagtattctctccagctacgtatatacacacatacatatatatcatagcaattccttgtggtttataacttgcaaatactgctatcagtttataggtaaagaaacagtgtgttaaatgacttatccaggagggtcctgtggcttcatgtttatggagttgctaggtctctgcctcatggtccagtgcctgttaagccactgtgttcattctaataggcataatgaattgttaaagaatttactaaaatctcttccaccaaactttgaaaaataatgaagccgcccccactttagaggctctgtatgaaaaaatgctgtggagacagagccctcctggctccctagctgatcctggagatgcagcaatagatgaatgggttatctctgaatttgtaagagataattcacatgaggattaagataaaatgggaagtaaaatctaacaaacacaaagatagctcccaggcactgctttgtgtagtttgacagcattgtggttgtagcagcaaaggacttaaagtgatagtttttaaaccatattctgtccctaagtaataaaaaatctaggaagttactaaaataccagatttgttctgctctgcctcatctagaatcaacgtctaactaacttaaatgaagtataataaatgagttcatatgaaaaggcttcctctatggacacttagatatattgtaactattgaagttacctgggatgtgggggcggtgggaggaggacctgcctccccaggacatctatgactaaggcctggctttagttatggagagagacgtagaagttgaattttacacccaaaattgatgtgactgaagaggaactgattgttgctaaccagctcacaagaatccagtattgagaccagttcactagaagaaacaaacatttctgtgcatgtgagaaccaaaaaagttattacgttggtgaatatgtattttcttctttggaaggtctttaaggggagcaaaccagttttaatcaaatcagattgcttggtaagtttggaatctgcaatcagttggtctta

SEQ ID NO: 230 - DNA, 5056 bp, Homo sapiens
  misc_feature: Incyte ID No: 331120.16c
  unsure 433-455: a, t, c, g, or other
gtctttcaaggtttattatttacagaaactgttttcccattggttttgtttccttcccccaaggtaagacaatgcccggagagaaactccattgctagggcattggcaaaagatttgccagaccctgacacctgactcaaccttgctctcctccaatcggtgcctccaactgcacccacccaagagagtgaagaccaaagtgcttctaccaagagggtacaggttcctagcctggctctatttttcagagggaagcattgtttctgcggggacatgcctgttcacttccatggcactgctgacttgtgctcaccctatgacgcctcgcccagagcacaggaggacagtatccactgcggggcgttcaccccacgcgagcggggacaacaggtctagccctaaacaactgcttgcctggctataagaggagccnnnnnnnnnnnnnnnnnnnnnnnagattccagaagatgcagtatttttcctaaggcaggagaaaaccctagttcatagacagccaggataaaaaccctggaagaccatgagccaaggtgaacgaagaggaattttctaaatcttggggacagagaattatgttacatcaaggcagccatgccaataaaatggaaggctatgaaagcaagcaaggcacaagaaaacccccattccacagagagacacaagtgttctatttggtgaagagtttggtgcacagacagactgcatcctgtgaagaggtggcccttgtcaaggctactgccgccaggaggatctttgcatctttaggatgtgtcactagctcatcgaaactatttctgtaactctctgcaagagccaatttaagctggcgtctcagttccctctgcactcaaaagagaccaatttccaattcctcctcagagtccgtgagaccagatgctacagcaaatgttccagagaaatgaacctagaaaatgatcccggggtgctccttgcgggggaacacaggactcctcagctctatctctgtggctttaacatacatcagtttcagggtgagtgctaccattgccccccgagagtgtttctgatgggacatgctttcctgatagcacaggggatcttgggggacagaaggttcccagtaaggctagggggcacgtgacagattgagagtgtgatcatgtttccaggtgagaccctattgcatctggcagcccgaattgggcaacaattcctgcaaataagaagccactgctcttgttaggtaggtcatcgtcccataagccccactcggagcgctgtcataaaagaagtggcagattcctgtggcttggtctttctccagggtgtccatggcaccaattgacacctggtcctgcaagaacagctgactggccatctgcacgatctggtccacgtggatgatgcccccgatgctggtcatctccgtgtccgagagcagcgtcagcaccatgatggcttccaccagcagctgccggtactcgggctgcggcacgcggttcagcaccgattcgacatggacagcaaacttgatctcatgcggggtcatctctcgggtcgtcgaggatgggaggacataaccatcgatggagagaccgtggcacttctggaggatcttccacaccctctggtagaatcccacggggaccctgttgatggccccatccagccttctcctgcgcagccactggccctgccgctcaccccagccgatgtgatgtcctcccgagtctgaggatgacgtgccagtgggcgaggatggggtgctggacctcgcagacttggaggaatgcgcactgctggacgcggcctggcccacagaaaagaactgttcatcagcactaaaccgcctagtcatctgtttcatttcactcctcagtctgttaatgccactcctctcagttttggtgactccggtatggcccacctcgtggatggagatggtagggctggatgtggaggagtggatagggcgcacacttctttcaacgccaaactctttcccacttagaatatggtgcaggagatttttcatatcgaaagggctgaggttcatcaaactttcagaagcctcttctcctgagcagttcaggctccgtgccagctccgtggccatcacctgaatgatcagtccaatccggagtctcagcatctccacaaagaggctgggctgcgccctgacatacatggccaggtaaaccacaatctcctgcgtgaggacggcaatgctgatgtcctgcccactggcctcgtagatgagttttgtgagctcctctgggggaaggggcgcagagatgatcttctcccggggctcgggcggcaggcccacggtgagctgcttctggtgcgaaagcaggtctgtgcaggcctcagccaggacctccactttcttcctgagaaggcctgagatgtagcgaatcagaccccactcctggttcaagccggctttcccatagagctcaccaagaaggttttgaacggtgaccccgtgctgtccagagagatttgtgtcccagctgggaccctttatgacataaagaatgtacagaatgtctgcttggtcctgtaggttcgaacaatcttttagctgctcaaccagcttctcacagtccacgtcaccatggtcatctctgggccactgaaagtcactttcaggaaccttttctaggagtggctgaggagaatcaacaagattcagtgatttacggtgggcacttagaactttagtcggcaaagtcatgggaacaaatggaacttccaaaccctttgcttttgccatcacagaaagtatgtcccgcgtggagtggatagcactgaagacatggcggtcttctgtgttcttacaaagaggaggcagataggacctcaacgatgtgctttgcagaaggtggttgatataatggtcaagttcgtcttggctttcttgattacaggtgtcttccagatatcctaccaaatctgaatcactatcaggactgaaagtcccttcgctggcattgtcaaacaacttctcatcacagtctggatccagaaaagtcagatatgtgtagaacgatgtggtgagaaattccgaaaggttccctaattttactctggctcctccaaaatatccatcctctagttttctaattgtggagagcacagcagaatgaatgtctgagccatcatttgtgagcatggtgcgactgatggggaaggtgagtgtgggtctgcccgtcatcctccagcaggtgcacaggtaggccagctcgatccttagcatctccacgatcatctcattgtcgagggccaggtagaagtgatgctggtcggtgaactggggtgtaaaagtaaagatttggttcctaatcacatatagtttagaggttccaaggacaccaatatgtcgatacggtcgcccactcaaattcatattcttattccgtccaagcttggcatatatgtgactaagaatccggcccggctggacttgaattggatgaatgtccgcgatactctggacgttcaccccgtgtttcctcaataagtccttaatgtgattgttttctgccaaaacagtaacttgtactacaacatcaggtttgactgaagtggaaaatcttctatttaagggatcgatttcaccagcggcaaggaatccctctgccaacagcgagctgaggatgtacaaggattggccccacagatgaggcaccttccccataggaactcggtctactgtgtgaggattcttgtactcttcatctaccttgttaggcgggacagcgtagagttcaggcaccaggcggatcccattcttgcctctgatgagtattccctccagggcctctcggtattcttggacctgaacagcatcaccactgaagactccatctattataaaatatgtccaaaacacaggccactcacattcaatgttttcgaagagcttgagttcagcagggtcataatgcagtcgattagggtcctctcttggagttttataaccatctcgaaggaagcgacagcatccataacgcccctggagcttagaaataatttcatttttggtcacatttacaaggtttacatcttccactgcaaaggccgggaaggaaataatggaaagaagtccagcatcaatttctttagatgtcgacgctcttggcagcatggagaacagaatagactggcagtgctcgacctcatctggcagaacatgaatcactgacttgcgtcctccatgggctccaaaaaggtccagttcatcaattgcctcaagagctgccttggccattcctacggagcttgcattcaattccgggatgccctgattagtcttatctccacgctcccacattccataatcagcgactttatatgcagcttctatgtaaaagacaagattctgtatgaaggccacctcatcgagagtgaaaatgatacgtaagcctgaggcggtcatctgggccaggaacaggaggaagagagaggtggcatccacctggaggtggccccactggtcgtcgcccaccaccgtgccacaggtggcggtgttgtacttggcgtgcaggctgtccttggtgctctgagtgtgtttgaacttctccactttggccacctgtctcatcatgcactggagaagacctcgcatcagcttcaccacgttctgctccagctcgtaggccttggccttgtcctcatcgcggtctgcattcttacggtaggccatgcccaggccccacacggccaggatactgtagatgttatcccgcacccaggcatccttctgctcatggctggctgacagcagccccgtgacgggattctggtaacacaggatggtttgctgcaccagccgcgcgtacccgtccaagcggaccccggaattgctcctgctccgcatctccccgaggctcccaggccgcagcgcccgatctgccgcgtgggcgcgggacgtcggggctgtggcctccaagcgggtctggttcccggacactcacagccttagtcggttcttgggatgggaccgggccggaggaggtcgagacttttctaaacgctagccccaaagtcc

SEQ ID NO: 231 - DNA, 798 bp, Homo sapiens
  misc_feature: Incyte ID No: 575983CB1
ctcgagccgctcgagccgggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagaaaaaaaaaa

SEQ ID NO: 232 - protein, 165 aa, Homo sapiens
  misc_feature: Incyte ID No: 575983CD1
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 233 - DNA, 5165 bp, Homo sapiens
  misc_feature: Incyte ID No: 413268.6
  unsure 2249, 2252, 2255, 2258, 2261, 2264, 3470: a, t, c, g, or other
actagttctctctctctctctaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagagtgggcatggcgacttggtctcagccggactcgggtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattacttcactgcccggcggctcctcagtcaggtgagggccctggacaggttccaggtgccaaccactgaggtaaatgcctggctggttcaccgagacccagaggggtctgtctctggcagtcagcccaactcaggcctcgccctcgagagttccagtggcctccaagatgtgacaggcccagacaacggggtgcgagaaagcgaaacggagcagggattcggtgaagatttggaggatttgggggctgtagcccccccagtcagtggagacttaaccaaagaggacatagatctgattgacatcctttggcgacaggatattgatctgggggctgggcgtgaggtttttgactatagtcaccgccagaaggagcaggatgtggagaaggagctgcgagatggaggcgagcaggacacctgggcaggcgagggcgcggaagctctggcacggaacctgctagtggatggagagactggggagagcttccctgcacaggtgcctagtggggaggaccagacggccctgtccctggaagagtgccttaggctgctggaagccacctgcccctttggggagaatgctgagtttccagcagacatttccagcataacagaagcagtgcctagtgagagtgagccccctgctcttcaaaacaacctcttgtctcctcttctgaccgggacagagtcaccatttgatttggaacagcagtggcaagatctcatgtccatcatggaaatgcaggccatggaagtgaacacatcagcaagtgaaatcctgtacagtgcccctcctggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttnctnctnctnttnctnttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagtggagttcctgcgctccctgcgacagatgaagcagaaggtccagagcctgtaccaggaggtgtttgggcggctgcgagatgagaacggacgaccctactcgcccagtcagtatgcgctccagtacgccggggacggcagtgtcctcctcatcccccgcacgatggccgaccagcaggcccggcggcaggagaggaagccaaaggaccggagaaagtgagcctggggaagaagggggtttgaagcccaccaagaccgaaactggagaagggctggacctggacctggacctggacctacagcggggacttaaatgccttcttatccaatatatcttctcagatgggatgactgcgggtcagtgtacaggaagaggcaggcactggctggctcagctccactcgggtggagtggaagtggccagaccatttagacggacagggtcctcaccctacccctttcctgtgaggcaggggtggtggtggagttgctggaggtagaggagctatgtggagcaaaggccgacagaggggaaggaatggacctgtgagaggaagggaaggtggcagaaagtctcatttcaggaaggagggatagaaggaaggaggaaggaacccccccccncccccgaaaaaaaaatcaaagcgggaagaaaatcagagggaaggttaaggttggctctggccaggattccaggcagcaggttggagtgactggtgggcctagatcactggtgtgataaaccccatttcaccccgggggggggtggggtacacagacacagggtgggggtggggaggggcggtgttaactctttctgctccttgcattttgacatccctgaaggggagctcttggatatcattggccatgtttcaatcgaatggagccactgggccccaacactggctttgagatttagagtcaaagggtagagtgaacaggaaagggtcacgtggtcccatgttgcaacagccccaacatcacgcatgtcattcactgccttgccactccatctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcattcttaagtgcactttttccccactttgaatttaaattgagaataaaggaaatggactcattgtagggaggactggccattgcgtggctaaggcagagctcacatgggaagatgggtggagaactggggaggttgacagtggggaacttcaaaaggcaagtcttaaatattgtattaaaccttgggggcaggcattagacaccatgtacttcatagggttagccagctcaatcctctcaggaaggattcggagtttttaa

SEQ ID NO: 234 - DNA, 2678 bp, Homo sapiens
  misc_feature: Incyte ID No: 1989186CB1
cagacactgaaatctgatgttttgttgggaactgctgcattagatatttatgaaacattaaagtcaaacaatatgaaacttgaagaagtagttgtgactttgcagcttggaggtgacaaagagccaacagagacaataggagacttgtcaatttgtcttgatgggctacagttagagtctgaagttgttaccaatggtgaaactacatgttcagaaagtgcttctcagaatgatgatggctccagatccaaggatgaaacaagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctggttgggagcagagagtggaccagcacgggcgagtttactatgtagatcatgttgagaaaagaacaacatgggatagaccagaacctctacctcctggctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatgggaatcaagatttatttgctacatcacaaagtaaagaatttgatcctcttggtccattgccacctggatgggagaagagaacagacagcaatggcagagtatatttcgtcaaccacaacacacgaattacacaatgggaagaccccagaagtcaaggtcaattaaatgaaaagcccttacctgaaggttgggaaatgagattcacagtggatggaattccatattttgtggaccacaatagaagaactaccacctatatagatccccgcacaggaaaatctgccctagacaatggacctcagatagcctatgttcgggacttcaaagcaaaggttcagtatttccggttctggtgtcagcaactggccatgccacagcacataaagattacagtgacaagaaaaacattgtttgaggattcctttcaacagataatgagcttcagtccccaagatctgcgaagacgtttgtgggtgatttttccaggagaagaaggtttagattatggaggtgtagcaagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggctctgttccatgggaaattcatagacacgggtttttctttaccattctataagcgtatcttgaacaaaccagttggactcaaggatttagaatctattgatccagaattttacaattctctcatctgggttaaggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcagaatggtagctgagtggaggttgtctcgaggtgttgaagaacagacacaagctttctttgaaggctttaatgaaattcttccccagcaatatttgcaatactttgatgcaaaggaattagaggtccttttatgtggaatgcaagagattgatttgaatgactggcaaagacatgccatctaccgtcattatgcaaggaccagcaaacaaatcatgtggttttggcagtttgttaaagaaattgataatgagaagagaatgagacttctgcagtttgttactggaacctgccgattgccagtaggaggatttgctgatctcatggggagcaatggaccacagaaattctgcattgaaaaagttgggaaagaaaattggctacccagaagtcatacctgttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatatgtgttcaaagtctcacttgggagtagtgtttttttctttagacattcgcagtga

SEQ ID NO: 235 - protein, 752 aa, Homo sapiens
  misc_feature: Incyte ID No: 1989186CD1
MKLEEVVVTLQLGGDKEPTETIGDLSICLDGLQLESEVVTNGETTCSESASQNDDGSRSKDETRVSTNGSDDPEDAGAGENRRVSGNNSPSLSNGGFKPSRPPRPSRPPPPTPRRPASVNGSPSATSESDGSSTGSLPPTNTNTNTSEGATSGLIIPLTISGGSGPRPLNPVTQAPLPPGWEQRVDQHGRVYYVDHVEKRTTWDRPEPLPPGWERRVDNMGRIYYVDHFTRTTTWQRPTLESVRNYEQWQLQRSQLQGAMQQFNQRFIYGNQDLFATSQSKEFDPLGPLPPGWEKRTDSNGRVYFVNHNTRITQWEDPRSQGQLNEKPLPEGWEMRFTVDGIPYFVDHNRRTTTYIDPRTGKSALDNGPQIAYVRDFKAKVQYFRFWCQQLAMPQHIKITVTRKTLFEDSFQQIMSFSPQDLRRRLWVIFPGEEGLDYGGVAREWFFLLSHEVLNPMYCLFEYAGKDNYCLQINPASYINPDHLKYFRFIGRFIAMALFHGKFIDTGFSLPFYKRILNKPVGLKDLESIDPEFYNSLIWVKENNIEECDLEMYFSVDKEILGEIKSHDLKPNGGNILVTEENKEEYIRMVAEWRLSRGVEEQTQAFFEGFNEILPQQYLQYFDAKELEVLLCGMQEIDLNDWQRHAIYRHYARTSKQIMWFWQFVKEIDNEKRMRLLQFVTGTCRLPVGGFADLMGSNGPQKFCIEKVGKENWLPRSHTCFNRLDLPPYKSYEQLKEKLLFAIEETEGFGQE

SEQ ID NO: 236 - DNA, 957 bp, Homo sapiens
  misc_feature: Incyte ID No: 337448.1c
gttttgaaggaggagcaggaggcactgtgcttggatctgtggggcacagagaggcgagaggagaggagggagcctgagccccacagcaggcaaggacaagctctgggggtcaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccagggggaactccaagagactcccactgtggactccaaagatcatgatagcagctctggactatgatcctggggatgggcaaatggggggccaggggaagggtagcatgtgctccaagtgccactgtgttaaactgatggtagtccttaagtgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgg

SEQ ID NO: 237 - DNA, 1187 bp, Homo sapiens
  misc_feature: Incyte ID No: 228304.19
  unsure 52, 57: a, t, c, g, or other
agagagttgtagaattttctagagtattctgttctaaaaacaacagaagttngaggncggagaggggatgctttggtttttcttgattatgactttgggcagaagtaaaaataaaaactacacatttccattcttaggaatgggaattaccaagaataaatgggaatgcacccagctggtacctgtctaggaagaaggactttgggatgaagaggttgttgacagcaggcctctggacattgttaagggactgaaacatagaatattggctccaaggaagagactgtccagacctaactgatcaaagaagaaattatagacagtgcttttaataatttgtctttttaaccccaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacatgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataatagctaaagggctgactttcacttcgaaa

SEQ ID NO: 238 - DNA, 2254 bp, Homo sapiens
  misc_feature: Incyte ID No: 420527.25
  unsure 231, 241: a, t, c, g, or other
aaaatgccgtagtgttattcttgtaggcccaatctttttttcccccaaattagcactttaattttatttactgtaaaaaaattggttttcttagattaggtaggaaatcttaatttggcccccgcctactttgacaagtaaatattacatcatacgattttgcaacattaaattagaacactagaaactaaaaaattatgtttcagtgaatgctacaactaagcatttttntttttaaganaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacatag

SEQ ID NO: 239 - DNA, 3685 bp, Homo sapiens
  misc_feature: Incyte ID No: 998034.3
cggccgcgtcgaccggctgcgctcaccggtaggccccgctcgggttccgccgaagcccagcccccgcaggtcggcccctccgacgccggccgcgccgcaagggaggccagctcgctcgcagtggggaggtcgcggctccagtcctcgcgtccccgccgtggtcccggtgcctgtcccatcccgcgggcggggccgttgcggggccgggcccgggccggggcgaatctgcggctgcgaatcggctggagcggggcctcgcgagaggccgaggctgggcggctgggctgggcgggcggccggggctgctccggaggctcgggtggcttgagagtcttgggaggctccgggcgctgcgcccgcgcggtcgccggcatgacgggtcgcgtgtgccgcggttgcggcggcacggacatcgagctggacgcggcgcgcggggacgcggtgtgcaccgcctgcggctcagtgctggaggacaacatcatcgtgtccgaggtgcagttcgtggagagcagcggcggcggctcctcggccgtgggccagttcgtgtccctggacggtgctggcaaaaccccgactctgggtggcggcttccacgtgaatctggggaaggagtcgagagcgcagaccctgcagaatgggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcacatgctcctggacctcagcgacctgctccaggtgaatgtgtacgtgcttggaaagacgtttcttctcttggcaagagagctctgcatcaatgcgccggccatagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcagcgctcctggttgcagccagaatgcatgacttcaggaggactgtgaaggaggtcatcagtgtggtcaaagtgtgtgagtccacgctgcggaagaggctcacggaatttgaagacacccccaccagtcagttgaccattgatgagttcatgaagatcgacctggaggaggagtgcgaccccccctcgtacacagctgggcagaggaagctgcggatgaagcagcttgaacaagtcctgtcaaaaaaactggaggaggttgaaggtgaaatatccagttaccaggatgcaattgagattgaactagaaaacagccggccaaaggccaaggggggcctggccagcctggcaaaagatggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccaaagatgcttcaggagacggtgagctggacctcagtggcattgatgacctggagattgacaggtacatcctgaatgagtcggaagcccgcgtgaaggccgagctgtggatgagggagaacgccgagtacctgcgggaacagagggaaaaagaagcaagaatagcgaaagagaaggagctcggcatctacaaggaacacaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggttgaggcctctggtgtctacgcagccagcaaagaaggtggccacgggagaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctggcagatgatgggcagcaacgactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaaaaaaaaaggggccg

SEQ ID NO: 240 - DNA, 3845 bp, Homo sapiens
  misc_feature: Incyte ID No: 474165.26
  unsure 11: a, t, c, g, or other
cgacgcgcgcngcgtcccggcgctcggctttccctccgccggtcccgccctccgtcgcggcggcgcggtgtaccctgggatagggagcgatctccgagcgaggccggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaattttttaaaaaactaaaataacacttcacacccactaggtggctat

SEQ ID NO: 241 - DNA, 538 bp, Homo sapiens
  misc_feature: Incyte ID No: 697785CB1
cccacgcgtccggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaaaaaaaaaaa

SEQ ID NO: 242 - protein, 135 aa, Homo sapiens
  misc_feature: Incyte ID No: 697785CD1
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 243 - DNA, 3763 bp, Homo sapiens
  misc_feature: Incyte ID No: 346209.3
ggcaaaaatgaagaaatttgaagaggacctgctgcgtcctggaagaccagaattccaagctgagcaaggagcggaagctgctggaagatcgtctggccgagttctcatcccaggcagctgaggaggaggagaaggtcaagagcctcaataagctacggctcaaatatgaggccacaatcgcagacatggaggaccgcctacggaaggaggagaagggtcgccaggagctggagaagctgaagcggaggctggatggggagagctcagagctgcaggagcagatggtggagcagcaacagcgggcagaggagctgcgggcccagctgggccggaaggaggaggagctgcaggctgccctggccagggcagaagacgagggtggggcccgggcccagctgctgaaatccctgcgggaggctcaagcagccctggccgaggcccaggaggacctggagtctgagcgtgtggccaggaccaaggcggagaagcagcgccgggacctgggcgaggagctggaggcgctgcggggcgagctggaggacacgctggactccaccaacgcacagcaggagctccggtccaagagggaacaggaggtgacggagctgaagaagactctggaggaggagactcgcatccacgaggcggcagtgcaggagctgaggcagcgccacggccaggccctgggggagctggcggagcagctggagcaggcccggaggggcaaaggtgcatgggagaagacccggctggccctggaggccgaggtgtccgagctgcgggcagaactgagcagcctgcagactgcacgtcaggagggtgagcagcggaggcgccgcctggagttacagctgcaggaggtgcagggccgggctggtgatggggagagggcacgagcggaggctgctgagaagctgcagcgagcccaggctgaactggagaatgtgtctggggcgctgaacgaggctgagtccaaaaccatccgtcttagcaaggagctgagcagcacagaagcccagctgcacgatgcccaggagctgctgcaggaggagaccagggcgaaattggccttggggtcccgggtgcgagccatggaggctgaggcagccgggctgcgtgagcagctggaggaggaggcagctgccagggaacgggcgggccgtgaactgcagactgcccaggcccagctttccgagtggcggcggcgccaggaggaggaggcaggggcactggaggcaggggaggaggcacggcgccgggcagcccgggaggccgaggccctgacccagcgcctggcagaaaagacagagaccgtggatcggctggagcggggccgccgccggctgcagcaggagctggacgacgccaccatggacctggagcagcagcggcagcttgtgagcaccctggagaagaagcagcgcaagtttgaccagcttctggcagaggagaaggcagctgtacttcgggcagtggaggaacgtgagcgggccgaggcagagggccgggagcgtgaggctcgggccctgtcactgacacgggcactggaggaggagcaggaggcacgtgaggagctggagcggcagaaccgggccctgcgggctgagctggaggcactgctgagcagcaaggatgacgtcggcaagagcgtgcatgagctggaacgagcctgccgggtagcagaacaggcagccaatgatctgcgagcacaggtgacagaactggaggatgagctgacagcggccgaggatgccaagctgcgtctggaggtgactgtgcaggctctcaagactcagcatgagcgtgacctgcagggccgtgatgaggctggtgaagagaggcggaggcagctggccaagcagctgagagatgcagaggtggagcgggatgaggagcggaagcagcgcactctggccgtggctgcccgcaagaagctggagggagagctggaggagctgaaggctcagatggcctctgccggccagggcaaggaggaggcggtgaagcagcttcgcaagatgcaggcccagatgaaggagctatggcgggaggtggaggagacacgcacctcccgggaggagatcttctcccagaatcgggaaagtgaaaagcgcctcaagggcctggaggctgaggtgctgcggctgcaggaggaactggccgcctcggaccgtgctcggcggcaggcccagcaggaccgggatgagatggcagatgaggtggccaatggtaaccttagcaaggcagccattctggaggagaagcgtcagctggaggggcgcctggggcagttggaggaagagctggaggaggagcagagcaactcagagctgctcaatgaccgctaccgcaagctgctcctgcaggtagagtcactgaccacagagctgtcagctgagcgcagtttctcagccaaggcagagagcgggcggcagcagctggaacggcagatccaggagctacggggacgcctgggtgaggaggatgctggggcccgtgcccgccacaagatgaccattgctgcccttgagtctaagttggcccaggctgaggagcagctagagcaagagaccagagagcgcatcctctctggaaagctggtgcgcagagctgagaagcggcttaaagaggtggtgctccaggtggaggaggagcggagggtggctgaccagctccgggaccagctggagaagggaaaccttcgagtcaagcagctgaagcggcagctggaggaggccgaggaggaggcatcccgggctcaggccggccgccggaggctgcagcgtgagctggaagatgtcacagagtcggccgagtccatgaaccgtgaagtgaccacactgaggaaccggcttcgacgcggccccctcaccttcaccacccgcacggtgcgccaggtcttccgactagaggagggcgtggcatccgacgaggaggcagaggaagcacagcctgggtctgggccatccccggagcctgaggggtccccaccagcccacccccagtgaccctaccctgtccccagatgcactaacagatggggcccagcccccttcctccctggaccccacgggcccctgtcccaggaaccccgccctctgacttcttgccctttggaaatggtgcagcactctggcatttatcacccccacctgggtcccctgcaacctcccatcaaaggatgacccctaaacacagaggagcggggcaggcagggaggcaaggactggagctaccttgcttgttgggggactgggtacagttggcaagctgtgtttccatcagctccctgtcctcctttcttccctcgttattgatctatagacattaggaagggagtgagacggctcctccaccatcctcagccagtgcaacccattccctctgcttctctctctctatgtctgtgtccgtccctctccttccctaccctctcaccatctttcttggcctctctgagggtctctctgtgcatctttttaggaatctcgctctcactctctacgtagccactctccttcccccatttctgcgtccacccctgaactcctgagcgacagaagccccaggcctccaccagccttgaacccttgcaaaggggcaggacaaggggacccctctcactcctgctgctgcccatgctctgccctcccttctggttgctctgagggttcggagcttccctctgggactaaaggagtgtcctttaccctcccagcctccaggctctggcagaaataaactccaacccgactggaccatc

SEQ ID NO: 244 - DNA, 473 bp, Homo sapiens
  misc_feature: Incyte ID No: 167772CB1
ccggactataaagagagccgccggcttctgggctccaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgccaagtgtgcccagggctgcatctgcaaagggacgtcagacaagtgcagctgctgtgcctgatgccaggacagctgtgctctcagatgtaaatagagcaacctatataaacctggatttttttttttttttttttttgtacaaccctgacccgtttgctacatctttttttctatgaaatatgtgaatggcaataaattcatctagactagaaaaaaaaaaaagaacaaaaaaaaaaaaagg

SEQ ID NO: 245 - protein, 61 aa, Homo sapiens
  misc_feature: Incyte ID No: 167772CD1
MDPNCSCSPVGSCACAGSCKCKECKCTSCKKSCCSCCPVGCAKCAQGCICKGTSDKCSCCA

SEQ ID NO: 246 - DNA, 1291 bp, Homo sapiens
  misc_feature: Incyte ID No: 2514988CB1
  unsure 46: a, t, c, g, or other
gcagggggagaacagcccacctcgtgactgggggctgccccagccnaccctatccctgggggagggggcgggacagggggagccgtataattggacaagtctgggatccttgagtcctactcagccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaggtcacccaggaactgagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcaaaaaaaaaa

SEQ ID NO: 247 - protein, 316 aa, Homo sapiens
  misc_feature: Incyte ID No: 2514988CD1
MKVLWAALLVTFLAGCQAKVEQAVETEPEPELRQQTEWQSGQRWELALGRFWDYLRWVQTLSEQVQEELLSSQVTQELRALMDETMKELKAYKSELEEQLTPVAEETRARLSKELQAAQARLGADMEDVCGRLVQYRGEVQAMLGQSTEELRVRLASHLRKLRKRLLRDADDLQKRLAVYQAGAREGAERGLSAIRERLGPLVEQGRVRAATVGSLAGQPLQERAQAWGERLRARMEEMGSRTRDRLDEVKEQVAEVRAKLEEQAQQIRLQAEAFQARLKSWFEPLVEDMQRQWAGLVEKVQAAVGTSAAPVPSDN

SEQ ID NO: 248 - DNA, 857 bp, Homo sapiens
  misc_feature: Incyte ID No: 481231.16
gaaggaggtgcgtcctgctgcctgccccggtcactctggctccccagctcaaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctccaccgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgactaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttccc

SEQ ID NO: 249 - DNA, 2310 bp, Homo sapiens
  misc_feature: Incyte ID No: 481231.17
ggaggtgcgtcctgctgcctgccccggtcactctggctccccagctcaaggttcaggccttgccccaggccgggcctctgggtacctgaggtcttctcccgctctgtgcccttctcctcacctggctgcaatgagtgggggagcacggggcttctgcatgctgaaggcaccccactcagccaggcccttcttctcctccaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaactggcggtgctgaccttggccgtgctgtcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagatgctcggtggccttggcgtggtactcggccagtctggcgccgccgttctccttgagagcctcaaggcgcgcggccaagcgctggcgcagctcgtcgctgtagggggccagatgcgtgcgcagcgcgtccacatgggcgcgcgcgcggtcgcgcatctcctcgcccagtgggctcagcttctcttgcagctcgtgcagcttctggcgcgcgccctcttggagctctgcgcgcagcggctccaccttctggcggtagagctccatctcctcctgccacttcttctggaagtcgtccaggtagggctgcaccttggccttcacctcctccagatccttgctcatctcctgcctcaggccctctgtctccttttccaggttatcccagaactcctgggtcacagggccgagctgttcgcgcagcttgctgaaggtggaggtcacgctgtcccagttgtcaaggagctttaggccgtcaggaagagcacggccaaggtcagcaccgcagctttcatcctgaagggccgtgggggacctggaggagaagaagggcctggctgagtggggtgccttcagcatgcagaagccccgtgctcccccactcattgcagccaggtgaggagaagacacagagc

SEQ ID NO: 250 - DNA, 4200 bp, Homo sapiens
  misc_feature: Incyte ID No: 1045853.2
  unsure 128, 197, 395-532: a, t, c, g, or other
gcccgcagtgggcccaaagggcacctggcctgagctccatcctgtgctcagggggtagacgagggccccaatgggctgaagctcatctcggaagtgattggggagcgcctcggcatccccatgagtgngctgatgggggccaacattgccagcgaggtggctgatgagaagttctgtgagacaaccattggtgaganccccctggcacctgcatacacagtgcatctagttgcatcccctccccaaactgccccaaccccacttagccatctctttcccataaggcagagaaaggaaaatacaagcatcagaggtgaaggaggctgggacacccccagggaaggggcttcagggccttgcttagggaaacacagtgatgagccctccctcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccttccctcaaagccttgccccctcctcactttaggctgcaaggacccggcccaggacaactcctgaaagagctgatgcagacaccaaacttccgtatcacagtggtgcaagaggtggacactgtagagatctgtggagccttaaaggtgagaggggcacagaggcagctatggggtgaggagaaggccccaaaggaggtctggctgagctctgcaaggctgcaggtactccaggctctcactattgagcagtggttcccctttcctaccatgtcccatgcatataggaggagctgcagaagcaaggccagggccattcaggcggctgattattcatcatcagaccgtggacccccttgctcctgtcccattttagccccgtgtgggactccccaccctctggctccaggaggtggtcagggggacaaggagatgcccaggctaatgggagacaaaacatccttgacacccagacagactaatggccagaactatggatcctggacagctgttgacttagggctttacaatggaatggtcaatagatgggaagatcaactagagagaagagtggttttcagaaaatgtcctcgaggagggagtatggggcagggcttaagaaagggggtgcagcaaggggggaaaccaagaggcggaagtaggcttctaaaaggccacacactatacctctcttctgcagtgggtgtcacggctgatgaaatgagtatgagggggctccacatggggcctataggagggggtctttttctcacctatgacctccactccttcaagaatgtagtggccgtgggggctggcttctgtgatggcctgggctttggcgacaacaccaaggcggcagtgatccggctgggactcatggagatgatagccttcgccaagctcttctgcagtggccctgtgtcctctgccaccttcttggagagctgtggtgttgctgacctgatcactacctgctatggagggcggaaccggaaagtggctgaggcctttgcgcgtacaggaaaggtgggccccgggagaagggagaacagaggggcggctctgtaggcatccaggtagaggtgcttggcgggaggcatctctggagcacaaacattaagactgttgtgcacatccccatccctcttttcctcccaagaccccactcccatctgagctccagtctctccaccccctactgacaacccagctgctcccttttccaagctttaccctgaccagtcatgagtggatattctgaacctgtttcatactgtcttcttctaggagtctttctcagaccagcacagctctgctctgatcagcccaatcacccccgctgtcaaccccacacgcctttggccacaatgaagtgggtaacctttatttcccttctttttctctttagctcgggcttattcccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaaccatggtataggtaaaaaaaaaaagagaaaaaaggggaaagaaaaattatgc

SEQ ID NO: 251 - DNA, 1344 bp, Homo sapiens
  misc_feature: Incyte ID No: 336615.1
ggaggaggaggcagctacggtgataaagaagagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttgtgcaaaaaaaaaaaaaagg

SEQ ID NO: 252 - DNA, 1120 bp, Homo sapiens
  misc_feature: Incyte ID No: 1328423.2
  unsure 12, 27, 33-34, 1070: a, t, c, g, or other
gcatatgattangcttaataaatattntattannaggagaattaaagacctaaaagggaagaagttagactgttctagttctggtactgttgaggcactgatgaggataaatgatcatgcagaggtctcttcataattgaccccaatggagtcatcaagcatttgagcgtcaacgatctcccagtgggccgagcgtggaagaaaccctccgcttggtgaaggcgttccagtatgtagaaacacatggagaagtctgcccagcgaactggacaccggattctcctacgatcaccagcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttccatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtatttcattgtaaaacatacnaaataaacatattttaaaacatttgcattttaccaccaaaaaaaaaaaaa

SEQ ID NO: 253 - DNA, 551 bp, Homo sapiens
  misc_feature: Incyte ID No: 085282.1
  unsure 132: a, t, c, g, or other
tgaataccaatactgaaaaattgtttcttgcctcaccttgtcctatgaacaggaattaaattttaaagtattgccttaagatggctgtgctaaataataatcattgcaagagcaatacttttacctgtttcnagatgacaatattactaaaatttctcaaatgaagactttgttttagcttcaattacttcagaaaatataaattttaaagatgactatgagataaatcatgaactcagtggaattttcagatgagatggggcgcgttcagggtggtatgactgtagacggaattttcagatctttgttatttagaagcaagtataggtataacgtggactatcaactgatatctgcaaataatttggttaaaatgaaatttgattgtagtatttgttgctgtaggattataaatgtcaaatatcattgtaaacatttctatatttttagaaatatcttgggtggcctgaaacagaagtgaggaaatcaattttttaaggtgagccatttggtttttttaaaaaattgagattcaacttacataccataaa

SEQ ID NO: 254 - DNA, 3814 bp, Homo sapiens
  misc_feature: Incyte ID No: 1081605.3
  unsure 3792, 3796-3801: a, t, c, g, or other
gctttctttttcacagcagcacttttggtaagtcagtgtatggcattggcaagacaggagaagggctgggaaatctacaaacggctgggcatccagaacaactttccacctgttctcagtgttacccatcttctagtggacattggttgtaagattgaggtcatttgtttttgtcgtaggaagcagtgaccttcaaggacgtggctgtggccttcacggaggaggaattggggctgctgggccctgcccagaggaagctgtaccgagatgtgatggtggagaactttaggaacctgctgtcagtgggctatcaacccttcaaactagatgtgatattacagttgggaaaagaagacaagcttcggatgatggagacagaaatccaaggagatggatgttcaggaaggaagaatcaacaaaagatggagagtattcaggaagtaacagtaagctacttttcccccaaagagctttcctcccgtcagacctggcaacaaagtacaggtgggttaatcaggtgtcaagatttcctgaaagtttttcaagggaagaattctcagttgcaagaacaaggtaattccctcggccaggcttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgatgaactggaagtacacagaaaagaaaactacagctgccatgactgtggagaagatatcatgaaggtatcattacttaatcaggagtcaattcaaacagaggagaagccctatccatgttctgggtatagaaaagccttcagtaatgactccagctctgaagttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaagtgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattcccaggagtgtggtaatggcttcagtctggcctcacattttcaggaccttcagatagtccacactaaggaacaaccatataaacgctatgtgtgtagtaacagcttcagccataatttacatcttcaaggtcacccaaaaattcacattggagagaaaccacgtaaggagcatgggaatggcttcaactggagctcaaaacttaaagatcatcagagagtccacactggagagaagccctacaaatgcagtgagtgtggcaagtgctttagttcaagctccgttcttcaagtccactggaggtttcacactggagagaaaccctacaaatgtgatgtgtgtgataagaacttcagccgtaattcccaccttcaggcccatcagagagtccacacaggggagaaaccatacaaatgcaatgtgtgtggaaaggattttgcgtatagctctgttcttcacactcatcagagagttcacactggagaaaaaccatataaatgtgaagtgtgtggaaagtgcttcagttacagttcatattttcacttacatcaaagagatcacatcagagagaaaccatataaatgtgatgagtgtggtaaaggcttcagccgggaattcagatcttaatgttcatctcagagtccacacaggagagaggcctataagtgtaaggcatgtggtaagggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcctaaatccatgttctctagaatgtaagcttggtgaaagaagggactttgttcattgctagtctacaaaactaggacatttcataacgcaatgtaggtgctcagtactttttgctaaataactaaaagtatgtaaaggtaaaaggtttgaaatttttaagcgcattttttaaaacttaaaatgtatttggaggagaaatcctgcaagtaatcttaataaaatcatttcaagtaaatatttgaaatgtagaacaataagcattatgatgatctgaaataacattaatttgattgtaaccctattggggttagttcccaccctttgttccatcttgagcagagatgtgctgcatttcttaacgtttggtctctatacattataccatctgctgaagtttagctttgtgtgtgtgtatatgtacccatgtgtgcactttaaatatcagtacaaactgataaacaatgtttctggttaatgttgcaaaaatggaacactgtattttacataattgattttctactcctgccctgtgaattaaggcagagttttactgtaatatttgcaagtatccaaaatggttactgatgacaaatactttttaataaatgtccaaatcacaaaaaaaaanaacnnnnnnaaaaaaaaaaagg

SEQ ID NO: 255 - DNA, 233 bp, Homo sapiens
  misc_feature: Incyte ID No: 1053517.1
  unsure 69: a, t, c, g, or other
gggctgctgaacaagtgtgtgtttaccgctgaatgcttttgtgtgttctccacagttgtaatgagtttntcctctgtgactgatggccccaccgtcgcttttgctatttgattgctccccagtgtgagcagcctgttgatggagaaatcccaacttggccaggaagtccttcccaacttctctgcaggtggaaggctcccctgacacatggaatgtgcaggtcttcacaaaca

SEQ ID NO: 256 - DNA, 2622 bp, Homo sapiens
  misc_feature: Incyte ID No: 480169.76
ggcacgttcggcacgaggaagcaaggaggcggcggcggccgagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtatttttttttaattcttttgatacagagaagggtcttttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaaaaaaaaaaaaaaaagg

SEQ ID NO: 257 - DNA, 1002 bp, Homo sapiens
  misc_feature: Incyte ID No: 2636043CB1
gagctgctgcctgcccgccacatacccagctgacatgggcaccgcaggagccatgcagctgtgctgggtgatcctgggcttcctcctgttccgaggccacaactcccagcccacaatgacccagacctctagctctcagggaggccttggcggtctaagtctgaccacagagccagtttcttccaacccaggatacatcccttcctcagaggctaacaggccaagccatctgtccagcactggtaccccaggcgcaggtgtccccagcagtggaagagacggaggcacaagcagagacacatttcaaactgttccccccaattcaaccaccatgagcctgagcatgagggaagatgcgaccatcctgcccagccccacgtcagagactgtgctcactgtggctgcatttggtgttatcagcttcattgtcatcctggtggttgtggtgatcatcctagttggtgtggtcagcctgaggttcaagtgtcggaagagcaaggagtctgaagatccccagaaacctgggagttcagggctgtctgaaagctgctccacagccaatggagagaaagacagcatcacccttatctccatgaagaacatcaacatgaataatggcaaacaaagtctctcagcagagaaggttctttaaaagcaactttgggtccccatgagtccaaggatgatgcagctgccctgtgactacaaggaggaagagatggaattagtagaggcaatgaaccacatgtaaattattttattgtttcatgtctgcttctagatctaaaggacactagcattgccccagatctgggagcaagctaccaacaggggagactctttcctgtatggacagctgctgtggaaatactgcctgcttctcccacctcctcagagccacaggaaagaggaggtgacagagagagagcaaggaaagtgatgaggtggattgatactttctactttgcattaaaattattttctagcctgcaaaaaaaaaaa

SEQ ID NO: 258 - protein, 205 aa, Homo sapiens
  misc_feature: Incyte ID No: 2636043CD1
MGTAGAMQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGVISFIVILVVVVIILVGVVSLRFKCRKSKESEDPQKPGSSGLSESCSTANGEKDSITLISMKNINMNNGKQSLSAEKVL

SEQ ID NO: 259 - DNA, 2539 bp, Homo sapiens
  misc_feature: Incyte ID No: 2993696CB1
ctcgagccgcaagacagcacagacagattgacctattggggtgtttcgcgagtgtgagagggaagcgccgcggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggaggacaagaaggaggacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatgacccgtctgtgcagcaggacatcaagttcttgccgttcaaggtggttgaaaagaaaactaaaccatacattcaagttgatattggaggtgggcaaacaaagacatttgctcctgaagaaatttctgccatggttctcactaaaatgaaagaaaccgctgaggcttatttgggaaagaaggttacccatgcagttgttactgtaccagcctattttaatgatgcccaacgccaagcaaccaaagacgctggaactattgctggcctaaatgttatgaggatcatcaacgagcctacggcagctgctattgcttatggcctggataagagggagggggagaagaacatcctggtgtttgacctgggtggcggaaccttcgatgtgtctcttctcaccattgacaatggtgtcttcgaagttgtggccactaatggagatactcatctgggtggagaagactttgaccagcgtgtcatggaacacttcatcaaactgtacaaaaagaagacgggcaaagatgtcaggaaagacaatagagctgtgcagaaactccggcgcgaggtagaaaaggccaaacgggccctgtcttctcagcatcaagcaagaattgaaattgagtccttctatgaaggagaagacttttctgagaccctgactcgggccaaatttgaagagctcaacatggatctgttccggtctactatgaagcccgtccagaaagtgttggaagattctgatttgaagaagtctgatattgatgaaattgttcttgttggtggctcgactcgaattccaaagattcagcaactggttaaagagttcttcaatggcaaggaaccatcccgtggcataaacccagatgaagctgtagcgtatggtgctgctgtccaggctggtgtgctctctggtgatcaagatacaggtgacctggtactgcttgatgtatgtccccttacacttggtattgaaactgtgggaggtgtcatgaccaaactgattccaaggaacacagtggtgcctaccaagaagtctcagatcttttctacagcttctgataatcaaccaactgttacaatcaaggtctatgaaggtgaaagacccctgacaaaagacaatcatcttctgggtacatttgatctgactggaattcctcctgctcctcgtggggtcccacagattgaagtcacctttgagatagatgtgaatggtattcttcgagtgacagctgaagacaagggtacagggaacaaaaataagatcacaatcaccaatgaccagaatcgcctgacacctgaagaaatcgaaaggatggttaatgatgctgagaagtttgctgaggaagacaaaaagctcaaggagcgcattgatactagaaatgagttggaaagctatgcctattctctaaagaatcagattggagataaagaaaagctgggaggtaaactttcctctgaagataaggagaccatggaaaaagctgtagaagaaaagattgaatggctggaaagccaccaagatgctgacattgaagacttcaaagctaagaagaaggaactggaagaaattgttcaaccaattatcagcaaactctatggaagtgcaggccctcccccaactggtgaagaggatacagcagaaaaagatgagttgtagacactgatctgctagtgctgtaatattgtaaatactggactcaggaacttttgttaggaaaaaattgaaagaacttaagtctcgaatgtaattggaatcttcacctcagagtggagttgaaactgctatagcctaagcggctgtttactgcttttcattagcagttgctcacatgtctttgggtgggggggagaagaagaattggccatcttaaaaagcgggtaaaaaacctgggttagggtgtgtgttcaccttcaaaatgttctatttaacaactgggtcatgtgcatctggtgtaggaagttttttctaccataagtgacaccaataaatgtttgttatttacactggtaagcg

SEQ ID NO: 260 - protein, 654 aa, Homo sapiens
  misc_feature: Incyte ID No: 2993696CD1
MKLSLVAAMLLLLSAARAEEEDKKEDVGTVVGIDLGTTYSCVGVFKNGRVEIIANDQGNRITPSYVAFTPEGERLIGDAAKNQLTSNPENTVFDAKRLIGRTWNDPSVQQDIKFLPFKVVEKKTKPYIQVDIGGGQTKTFAPEEISAMVLTKMKETAEAYLGKKVTHAVVTVPAYFNDAQRQATKDAGTIAGLNVMRIINEPTAAAIAYGLDKREGEKNILVFDLGGGTFDVSLLTIDNGVFEVVATNGDTHLGGEDFDQRVMEHFIKLYKKKTGKDVRKDNRAVQKLRREVEKAKRALSSQHQARIEIESFYEGEDFSETLTRAKFEELNMDLFRSTMKPVQKVLEDSDLKKSDIDEIVLVGGSTRIPKIQQLVKEFFNGKEPSRGINPDEAVAYGAAVQAGVLSGDQDTGDLVLLDVCPLTLGIETVGGVMTKLIPRNTVVPTKKSQIFSTASDNQPTVTIKVYEGERPLTKDNHLLGTFDLTGIPPAPRGVPQIEVTFEIDVNGILRVTAEDKGTGNKNKITITNDQNRLTPEEIERMVNDAEKFAEEDKKLKERIDTRNELESYAYSLKNQIGDKEKLGGKLSSEDKETMEKAVEEKIEWLESHQDADIEDFKAKKKELEEIVQPIISKLYGSAGPPPTGEEDTAEKDEL

SEQ ID NO: 261 - DNA, 674 bp, Homo sapiens
  misc_feature: Incyte ID No: 240518.21
  unsure 37: a, t, c, g, or other
tgggcaaggctggtccctgtgtgatgagacatcaccntcccaggagcaaggcggaagtctggaggacgctgaggggcggaggcgggagaggcgagctcgcgatgagtggtctcggcaggctcttcgggaagggtgagccagggtgggactggccagccaggaggcgctggctggtgcaggggaagaggagaccccggcgagattcggccggaccgctgcgccgggcaggggaagagaatcaggagacaggctgactggaaaaccccggcggccgatggcggagcaaggctcatcgccggtgccaaaaggcacaccatgtcggggcgccttgttcccgtccgccgtcctcccccactctcagagggaagaactcaagatctgggaggggacttgagttgagggcgtggcgatcgtgctgactcccactgttcaggcttgaagacgagtttcctgctgtcttcagccattttcaaaaccttgttctataatactttgtgctgggcaagagggatctaagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccct

SEQ ID NO: 262 - DNA, 2015 bp, Homo sapiens
  misc_feature: Incyte ID No: 240518.34
  unsure 748: a, t, c, g, or other
tggcgcggctaccgaagctggcagtctttgatttggattacactctctggcctttctgggtcgacacgcacgtagaccctccgttccataagagcaggtgaggtagggacagggaagactgggggcgagataggacccagccagggctgagcgcactcttgccctctccagtgatggaactgtacgagataggcggggccaagacgtccgactgtacccagaggtgcctgaggtcctaaaacgattgcagagccttggggtgcccggtgcggctgcttcaaggacaagtgagatagaaggggccaaccagctactggagctctttgacctcttcaggtgttacctgcattcacatccagaatggaatgaatcttcaaactctaagtcaagggttagagacatttgcgaaggcccaaactgggcctttgaggtccagccttgaggagagcccatttgaggcctaaactgaaaggaaatcaagaaggcattttcaggtgcatttgtaatttattaaagttcatctgtgtgtgacagaagagattttacccacagtgtggggagtttctatttttctagcctgtgaaatggggttggttgtcctgacgtgcagagaccagaatgtgagacattagactgcatcaggtttgccatctaaacttagggcaaccccaagtgcttgaacctataccaccccactttcctgagctctgtaaagagcatgaagttttcccactgaccccatactctncgggtgccatcacactgcacatttccttccggagaacaagcacgtactcaggtggagatagaactgtctttttacttaatagaaaatgatgtggcagctttaagaggagcgcgtcggtctggggctggtggcttgggtcacgtgacaccggtggtctcgtttgcgcctcttgatgtcgcggcggcgccctgaggacggattgggcaaggctggtccctgtgtgatgagacatcaccctcccaggagcaaggcggaagtctggaggacgctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctgataaatctgggcttgtcttcctaatgctacctttgttggtcctttcttccttaagtgccaagtgctgagctaaaggaggataactttttggggaagtcatgctgagggtggtagtgtgaccctgcctgaaaaaagggtctcttaccctcccagccctggctcaactctgaagaaggatcttgctacagaaggagcccttgggctcccttctctttgatagcagttataatgcccttgttcccaataaaactgggcagatggaatcctagtgtctatactgccttgtctacccctgaag

SEQ ID NO: 263 - DNA, 4446 bp, Homo sapiens
  misc_feature: Incyte ID No: 001322.4c
  unsure 167-332: a, t, c, g, or other
aaactcaaggcaaatatatttatttttattttgtctcatacacacacagaaaaacaaataaaaatctagcctgagatttaaaactcactaaggaaaaaaaatcacagcaaaagcagtaggttaacatcaggatatttatattcaaggctctatggtatcaagttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgagattttttaaagtccatatttttttgttatttaaacgtgatattattcaacattgatgaacttgggtcgtgagttctaaaagggattcaaaataaaatggcattttcacttttttaaaattaagatactttttcatgatcaaaaatatgttgtgtctccctcctgaccctccttttcaggtaggtagcaaacgttgcgaaatttagttggcatatgcttcagacaaccttttacttaaatcattatcctcactgctatctttttttttgaagttgtatactcctaaaatgttttaagcacttaatttttcttttatattattaattgttttcaacccactaataagtaccattttgctaattgggaaattaatacatattgtcaaagaaacagactaaactgtattttgaaaatcctgaagaataaaaatttgtaaaaggaaaaaaactaaagacgaaaacatatttacatctctgacatcttcctactttaaaaattacaaagaaaatagaaaatagaggtgacttttaataacaaaaaagtccatttctcaatattaataaaaaaaagcaaaaatactcataaacacataggattaaaagtaatgattccaagagaagataatttagaaaaaggcatttaattacaaaattttcttttaaataaaaaagcaatggcacgaatcaccacaaaatcatttaagtgatcatatccacaggctgttcttgtaattatatgctaaaaatttatgactgttctcattaacagcattcccccccttcattagagacatcaagagcttctgagaatgtgtagtttttcctaaagtactactaaaagtatcatgaacaccgtttgtgcagcattcatttacatcaccttttatttactatattctaaactcataaaatatttaacatttctctacttcatttcttatttacagtacagaggctcatctcttgtcacaatatggtttgtgcattaaaatccctgggaatagtactttcaagaacattttaataaattgactccgattatttaaaataagaacacaaacaaaagctttttcacccagaagaataattcttccagtagacttattcaggacttaaaaaaaaaaatccctctttaagtaaaatacattcttcaaccattactggattatactatcatgcatatttataatgctaataatgacaacacgtaaagccagctatgacttttaaaattccatttagaagagtacagtagacagaaagtgctttggctttcactctcttgttatccataatccaattattatttcacatgggtatattttatttattcttagtatataagtatttaatggttcagtaataactggcagcttctgacagtcctattttcttggtcgctgatacggttctgtgaacataagtcagatgaactgaaaaaaaatgcaaatcacttcctgtgatacagcaggaaaaggtggaatgttattatttgagcaaatgattcaaagagatgaatactaacattctgtcgtgacaggaatactgtgaaattaggtatgttttaatgtgctgtcttcacaacttgccatacctggtatttgttatctttttggtcaaaaagcaaacctaactgggaaagggtagatgtgaggaggtaatagaggtgagagagcatatattacagtatatatgattttaggagaaaagaatgggaagagaagacatttccacatattaaaaaaaaaaactatgtcacatctggacacatttcacagagcatatgaaaactgcccacaaactaattaagcctctttactctcactccagaaattttttttctaataataacattaataataattaatataattctggcagcagcacaaatctatgactttttaaggcttaagagagtcatttttaaatacttgggtacaactgaataatatgagtcctgccatttcttttatttacactcttgactcagcaagaattatgacagaagtccacatggttatctgcagcttgttaagtcttctacaatggctttgactttataacccactcagcatttgggttaagctgatataaatccttcatgtaagtgtcatcatcaaggcagcgttccccaatatttcctccaatttcatacaaaaaaacttctcctttcttgagagtctgggcaaccccactttcttggctgagaaacctggcaagtacatcactggcttttagttcttcagttagctgtattgccatggaaactttcgaaagatggggagcttgcactcgaatcactccctgaggaacgtcagcatcatttgtactcttatcttgcttttcatatttttctcggtcataagccattttcttcagcaatttcttcatggctcttttatcctttttatgattttccgtgttttgcttcctcacttggtttacaataaacttgggaattgtccacagaagtttttggtacttaatcaataagtgcatggtatttgctgtcccagctgccattacaaattctcgctgttcactggacttcaatcccaatgcatgacacataaagagattcggggccatgaccattgctacattcatgactgtcattttatttttttctttattatctattactctttggagaaattcaagaagggccttcagtgtgtccctgtttgcatcaggtaggaggatgacaagaaggttcaaagcctgtagttgctgcttcttggttggaagattctggacagcctgaaaggctttgagatactccacactgagcagtggctggggcaactcccgaatgaagagcttcagcaggctggcggcatcatgctgtttgacactttcccaattaaaagtcccttcataaaactttgcttctagttcttggcaaagattcttgattctaatggcagctccagggatccgtaagaggccttctgtttccaaacctctctcttcaattcgagaaatcagtttttgaaagatcaagggtattcgcattcctggtactttcctctgatcttgttctaatagcgctgtcaatggaacgcaaaaaagaccagaatcttttgttttgattttcacagctttttgttgtttcagctcaatacccaatacatcatagagggcagtcagctcaattagggctaaatggcaaactttcttcatgtcctggggtgcgaggtcaccaatccttgtggtacccgttttgtcttttggcaatctgaaactaggtaatgtggcatcatcgcctttgctcttctggattttctccttggagctctctttctgattgagtgcttgctcggcaaatgatacctccaggttgatgtctgtttcaggggcaggcgtctcctcaggtgggatcagcttctcttcaccaacaaggttagatgcctcgtcatctcttccttggtatttgttttcatttgttctaagtgactgcgattcagtgccacctggagctgtttcttttgattctctctgttgagcaaatatgtctctgacgtcaggaatctggtactgtttgttttttttcctcaaggtctgggagaccgtctctactcgcttctgaactgctgctgcctgggtccgcgtcaatgttgataaaaacacaatgctttcctgtggatctccagcagactctccgaagagattggataaaccggcctctttaagccactcttcttccaattctccctcatcaggctctttgacaacaaccacctcttgatcttcttggctgttttcactagatttcttgatgttttctagttctatccaatagtcttccatagatagttcatccaaagaatcctgggaaattgatcgatcaaatggaggcttctccataactttgatggtggtgctttcctggttcatagtgtactggccatatctgcgactcgaggtggcttcctcccctgcctttgcatggctgttcccgacggcctggtccttgccgctggggtggtaggctgttagtaccactccctgggaactggagagccagctcatggtgagagaagggacatactttctgcgatcctgacacagagaaggggaaagaagttcctgtctcgcctggcaactcgc

SEQ ID NO: 264 - DNA, 552 bp, Homo sapiens
  misc_feature: Incyte ID No: 350502.3
gaacttcagggttgattcttggttttttattcaccgtatcaggttcttgagtatccccagatcacaccaattttccctcaatcttatgcccccttcctattccctgccagggtcccctgtcccgtctccaccccttatcataccagaaagatgggatcatcatggccaagtgggaggcctcagcactcactcttccctacatccccattactcccccatcctccctccccaagcttctctgtcccttcatctccccttccacaggccgcatctggctggacaacttgagctgcagtgggaccgagcagagtgtgactgaatgtgcctcccggggctgggggaacagtgactgtacgcacgatgaggatgctggggtcatctgcaaagaccagcgcctccctggcttctcggactccaatgtcattgaggcccgtgtccgtctaaagggcggcgcccaccctggagagggccgggtagaagtcctgaaggccagcacatggggcacagtctgtgaccgcaagtgggacctgcatgcagccagcgtggtgtgtc

SEQ ID NO: 265 - DNA, 1016 bp, Homo sapiens
  misc_feature: Incyte ID No: 350502.4c
ccgcctgcccgcccaggcgtcggccacgagagagcgggagcctcgctggtccccatttcaggtactcccttggggcacctttcgtggtcccacaagatttcccaactctccagctttgcaacggcctccatattttcccgcgcgtcccgacccccgggtcctcccgtgccccggacctgctcagatgtctcccaaggctattcatcagggagcaccccaatcccggcctgctccgcccggcgcccgcggcccctcacctgtagaaggccgcgttgaccctcttttcgctggggaagcccagcatcccgcagaccacgtggctgttgtgggcgctccagcctttgtcgcacacttgcgaccagccgtcaggaagcctgacttccaccagcccctccgtcacgggcaggggtcgtctgccccacccaacggcgggtcgaattcgcacctcctccacttgcaggtgatgctctacctcaatgacattggagtccgagaagccagggaggcgctggtctttgcagatgaccccagcatcctcatcgtgcgtacagtcactgttcccccagccccgggaggcacattcagtcacactctgctcggtcccactgcagctcaagttgtccagccagatgcggcctgttccagggccatatttggcactgtgggtccagcctgtggcctctgtgaagcccagctcccggcagaggatgtgggcagcctgcagcgtgaagtcatcatcgcagatggtgccccattcaccagctcgctgtatctccacgcggccctcgtagggcttcctggggaagccagccagccggaaccgaagcccctggctcccggccttcttctcagggcccgtggaaggggacggagaccccaagcacgaactgcacagcaggcacagcagcagcccccaggggctccactgccagacactgacaggtcgcatggcagggaaggccttggccgagcaggaccctaagggctgggagaagagtgctggtcctggagatcag

SEQ ID NO: 266 - DNA, 1843 bp, Homo sapiens
  misc_feature: Incyte ID No: 253783.3
  unsure 1824: a, t, c, g, or other
gcacagggcaaggccctggggctcctggcttctccctccatgcacagcccggagctcccagccctcaccctaaccctgggctctaccccagctgtcaccgagggcctggggtgcgacggctgatggatgacggagggaaaggaaggggcgggtccctgaggcctcatagctctcccaggcgccgaccctgccatggaaccgttagtataagggaaggaggggttggggtggggaatggtatggcccatttagaccagccggagaaccagctagaacgctgttacgatacaagtgcctgcctgccctggactcagactccgtcgggctgagcatcggtcaggtttccaagctccccaagtgtttctggacctgcaggtttgaaattctgcctctgagaagctaacagtcttcctgtggtcgccactcctccccagcagccccctccttgccaaggacggtccagaaggagccccactggggcctgccccgctcagcaaagcagacctcacctcccactaccagcttgaagtcacagcagccagaggaaattctgccaccattttcccaggtctgcagcccctccagctgggaacctgctcctggagccatccctctgcaaacagagagcccagagtgcctcggggaaaattggctgaataaaagagcgatcaggacgccacggctccgcctgaagcgatggcccagccctacccccccgcccagtacccccctccgccacagaacggcatccctgccgagtacgccccgcccccaccgcaccccacgcaggactactccggccagaccccggtccccacagagcatggcatgaccctgtacacaccagcacagacccaccccgagcagccaggctccgaggccagcacacagcccatcgccgggacccagacagtgccgcagacagacgaggcggcacagacggacagccagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggcactggagcaaacgcttgttaaaatgccagtcccatgggcggggctggcaccgtgccccctccctcctcagcagacaccggagccggcctaccccacctctccagcgttcccaccactttcttgtccgtttgcttccagggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaanaacaaaaaaaatcacaaaa

SEQ ID NO: 267 - DNA, 869 bp, Homo sapiens
  misc_feature: Incyte ID No: 085119.1
  unsure 847: a, t, c, g, or other
gctttttccagccggagacaaactttttgggggtggggtaggtggggtatggagggagagttgactagggctgcgggtaacccagcgcctactgccggggaagactcggacgaaaaccgaggcaaaccaaccattaaaaagtgcatccaataagaatttttccactcaggccctccgctgccgagacgcggcagactcccagagcggctcacccactcatcgaagcggattctgggcggtttcgggctgacccgcgctgtcagggcgcggactccattccgggcgcattgttaggagaaggggcccctcggggcggcgcgcctcgaccctgggctcccggtgcccgcagagggcggagatccgcggcgccctaggccacctatccgcatcttctcgagccaaacccccagcgcttacccggacccgacggcccaagcactgactcccaggcaagagtcgcccttcctggtccccagggaactgacactaccgcgggacgttccctctaggacagtcagcaggtcccaggagcgcagcacgcaacagcgcagagcagacccagacttttcccggggtgagacccggaggcccgcgctctggaccgtcctccctacccagcctggaggccggcgttccccggcccaacccggagacctccccgcctccctcctgggccgccgcgcgccccagttggagcagcctcgaggggctgggccctttcggccggactcccttctcccggacatccaaaacaggttaccttgtccacgctctccggaccacgctttggacttgctcacttttatttaagagtccgacgggggaaagagggaaaaaaaatccagangagatccaagtcaattggaaga

SEQ ID NO: 268 - DNA, 5687 bp, Homo sapiens
  misc_feature: Incyte ID No: 902559.1
  unsure 4850-5163: a, t, c, g, or other
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggagggcactgccacatgcaatgggctcgggctctgatacttgtgctcaatgtgcccattttcgagatgggccccactgtgtgagcagctgcccccatggagtcctaggtgccaagggcccaatctacaagtacccagatgttcagaatgaatgtcggcccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctcctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggagtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtagaagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttcacaaaaaa

SEQ ID NO: 269 - DNA, 2188 bp, Homo sapiens
  misc_feature: Incyte ID No: 4113161CB1
cggacgcgtgggtgcttagcaacggggggaggcaatgtggctgaaggtggggggcctacttcgggggaccggtggacagctgggccagactgttggttggccttgtggggccctggggcctgggccccaccgctggggaccatgtggaggttcttgggcccaaaagttttaccaggatgggcctgggagaggcctgggtgaggaggacattcgcagggcacgggaggcccgtcccaggaagacaccccggccccagctgagtgaccgctctcgagaacgcaaggtgcctgcctcccgcatcagccgcttggccaactttgggggactggctgtgggcttggggctaggagtactggccgagatggctaagaagtccatgccaggaggtcgtctgcagtcagagggtggttctgggctggactccagccccttcctgtcggaggccaatgccgagcggattgtgcagaccttatgtacagttcgaggggccgccctcaaggttggccagatgctcagcatccaggacaacagcttcatcagccctcagctgcagcacatctttgagcgggtccgccagagcgccgacttcatgccccgctggcagatgctgagagttcttgaagaggagctcggcagggactggcaggccaaggtggcctccttggaggaggtgccctttgccgctgcctcaattgggcaggtgcaccagggcctgctgagggacgggacggaggtggccgtgaagatccagtaccccggcatagcccagagcattcagagcgatgtccagaacctgctggcggtactcaagatgagcgcggccctgcccgcgggcctgtttgccgagcagagcctgcaggccttgcagcaggagctggcttgggagtgtgactaccgtcgtgaggcggcttgtgcccagaatttcaggcagctgctggcaaatgaccccttcttccgggtcccagccgtggttaaggagctgtgcacgacacgggtgctgggcatggagctggctggaggggtccccctggaccagtgccagggcctaagccaggacctgcggaaccagatttgcttccagctcctgacgctgtgtctgcgggagctgtttgagttccgattcatgcagactgaccccaactgggccaacttcctgtatgatgcctccagccaccaggtgaccctgctggactttggtgcaagccgggagtttgggacagagttcacagaccattacatcgaggtggtgaaggctgcagctgatggagacagagactgtgtcctgcagaagtccagggacctcaaattcctcacaggctttgaaaccaaggcattctccgacgcccacgtggaggcagtgatgatcctgggggagcctttcgccacccagggcccttatgactttgggtcgggggaaacggcccgccgcatacaggacctcatcccggtgctgctgcggcaccggctgtgtcccccacccgaggagacctatgccctgcaccgcaagctggcaggggctttcctggcctgtgcccacctccgagcccacatcgcctgcagggacctcttccaggacacctaccaccgctactgggccagtcgccagccagacgcagccactgccggcagcctccccaccaaaggggactcctgggtggatccctcatgacagcctccatgggggattcagtccccagagcaggccgtaccctgctgtagtgcctcttatcccttccccgtctgccctgggtcagaggagcccccttgggcttcccagtcttgcctggctctcctccttggcccaggagctcaggatccctggggctggggaactcccaacttcgtgccctagatcctgcacctccccactcgaaagtgggtatccgaaaactaagccagggaagcggttaacttatctttgccaacatttgagggagccttgggccgctgcatgtcgttatgcagatcagactcatcagggggagccctcacctctgcctcaagcctcccgtggaaggcgagatggtcctggaggcagtcctcacctctgcctccctcgctcctccaacagctgccttctcccgggttccagcctctcagtgtgttggagaggtaggggtgcggggtgggggggagctgaatcttcaatcggaataaaagcagccctccccttaaaaaaaaaaaaaaa

SEQ ID NO: 270 - protein, 544 aa, Homo sapiens
  misc_feature: Incyte ID No: 4113161CD1
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 271 - DNA, 442 bp, Homo sapiens
  misc_feature: Incyte ID No: 2757583CB1
cctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgcaagtgcaaagagtgcaaatgcacctcctgcaagaagagctgctgctcctgctgccccgtgggctgtagcaagtgtgcccagggctgtgtttgcaaaggggcgtcagagaagtgcagctgctgcgactgatgccaggacaacctttctcccagatgtaaacagagagacatgtacaaacctggattttttttttataccaccttgacccatttgctacattccttttcctgtgaaatatgtgagtgataattaaacactttagacctgaaaaaaaaaaa

SEQ ID NO: 272 - protein, 61 aa, Homo sapiens
  misc_feature: Incyte ID No: 2757583CD1
MDPNCSCAAGVSCTCAGSCKCKECKCTSCKKSCCSCCPVGCSKCAQGCVCKGASEKCSCCD

SEQ ID NO: 273 - DNA, 1077 bp, Homo sapiens
  misc_feature: Incyte ID No: 198317.1
  unsure 935, 943, 945, 947, 951: a, t, c, g, or other
tcaaatctgtgcaggggggcaccaagtaagaggaacagactttatactaacctttaggaagtataggtgggctttgggggctgggcagccagttttcacttaatttttcctgatttacatattagaaaatcctgggaagggctctttagggtccctcaccccccacccccttggatctttggtgcaacaaatactactgatgaaagcaccagtgtttgtgacaaacatctccctatcccaagaaaatcgtgcctggttgcaggggacgcttgacagcacttggccccgtgacagcccctctccgggccaggtccctgccacagtcttcggacatcactgcagtgtcttcaacgtggctttggccgccccctcgtccggcccacgctgatcactgcaaattcaccccaccccacctcacgcagatttcaatgtaatgaaccaacacaggatgttttaaactattagggaaacattgtttccataatattctcaccagaaacagatgtggaagtggcagcccgtgtttacagtttctcattttttttgtccccctttaaattaccattatgggtaaatcattgtttccctttaaaacaaaaaacaaatcagtacccctgcctacagaaaagaagagggaacatttatttaaaggatggaaagactgggagttaggcactcccagcctcactgaggggcatttttgcctttgagaagtcctcccaggtatcctggtatagcacaatgtggcaatccgtagtgggaatgaagattaaacaggagagactttgtattagacctgtgagacgagttaggaagccctgcctggcatggggaatgcaaacagggaacattcaataaatcggggaacttgcttttctccccaagaccccagatggggcctacccatcgttctcgtgtaacaaaacgtgtaaaanaaaaaaangnanaagnagaaacaaaacaaaaaaactaagttgaccagtctgttttcactggtatgagagcattaaccgcactagatttcaagcacctgaaggcactagtttgtaattactagctggttggcacagtcctgtt

SEQ ID NO: 274 - DNA, 3282 bp, Homo sapiens
  misc_feature: Incyte ID No: 1508254CB1
  unsure 3130: a, t, c, g, or other
ccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactgctcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctccntaaaacatgaaatgatctcccttagtaatccccttgccaaattcatgtccctgtaaactctacaggatggggacactattgaggtacggtttcctcactttgggcctgaacatgcattctcaagtggggtgatcccccacaataatgtttta

SEQ ID NO: 275 - protein, 917 aa, Homo sapiens
  misc_feature: Incyte ID No: 1508254CD1
MIASHLLAYFFTELNHDQVQKVDQYLYHMRLSDETLLEISKRFRKEMEKGLGATTHPTAAVKMLPTFVRSTPDGTEHGEFLALDLGGTNFRVLWVKVTDNGLQKVEMENQIYAIPEDIMRGSGTQLFDHIAECLANFMDKLQIKDKKLPLGFTFSFPCHQTKLDESFLVSWTKGFKSSGVEGRDVVALIRKAIQRRGDFDIDIVAVVNDTVGTMMTCGYDDHNCEIGLIVGTGSNACYMEEMRHIDMVEGDEGRMCINMEWGAFGDDGSLNDIRTEFDQEIDMGSLNPGKQLFEKMISGMYMGELVRLILVKMAKEELLFGGKLSPELLNTGRFETKDISDIEGEKDGIRKAREVLMRLGLDPTQEDCVATHRICQIVSTRSASLCAATLAAVLQRIKENKGEERLRSTIGVDGSVYKKHPHFAKRLHKTVRRLVPGCDVRFLRSEDGSGKGAAMVTAVAYRLADQHRARQKTLEHLQLSHDQLLEVKRRMKVEMERGLSKETHASAPVKMLPTYVCATPDGTEKGDFLALDLGGTNFRVLLVRVRNGKWGGVEMHNKIYAIPQEVMHGTGDELFDHIVQCIADFLEYMGMKGVSLPLGFTFSFPCQQNSLDESILLKWTKGFKASGCEGEDVVTLLKEAIHRREEFDLDVVAVVNDTVGTMMTCGFEDPHCEVGLIVGTGSNACYMEEMRNVELVEGEEGRMCVNMEWGAFGDNGCLDDFRTEFDVAVDELSLNPGKQRFEKMISGMYLGEIVRNILIDFTKRGLLFRGRISERLKTRGIFETKFLSQIESDCLALLQVRAILQHLGLESTCDDSIIVKEVCTVVARRAAQLCGAGMAAVVDRIRENRGLDALKVTVGVDGTLYKLHPHFAKVMHETVKDLAPKCDVSFLQSEDGSGKGAALITAVACRIREAGQR

SEQ ID NO: 276 - DNA, 4350 bp, Homo sapiens
  misc_feature: Incyte ID No: 474691.3
  unsure 1508, 3344-3346, 3348, 3365, 3368, 3371-3372: a, t, c, g, or other
tgaaattgtgaattctaaaaaagaaatgttgtaaatacaattccattaactacatagaaactattaagaaagagagaatcaaaaatatttttgtgagggagtcggtcccaggcagtttgatgctctgtggaaggaggcgggaagggaacgttggccaagtcagttactgagatgaagatcgcccagctgccaggaccaccccaggacaagttagagcactgtttagctcctttgtctgtgtgatagacctaagaactgtattagtgttgtaccagcctattaacctcttgtctgtgcacagcttcaaatgttaccgtctagttagatttttatttaaaatatgaaaaactgcttttcccaagatgttttttaaaaacaaagctacaattttaatatttaacatatttaaagtttcaaagcacacctgtttggcttgggtgggggtggggtgggggggacattctttttcagtcttaatttttaaatatttgatcattttctattgtccaatcatttcagcacctccaaaggtccctaggacactttgcctctcttctccccctgccccccaccctgctcccacatctgggggcccatgggccaggagtggataagcctgcattaatacaacctttctccattcactttctatttacaaattaggaaagcaaccttttggtttatatatattttttttaatacctcagtgctgcaagtatcaccagagaggctatggaagaatttttttttaatttattgtagatgtaaacagaattttaaaaataaaaagtataaacatcactgcactgtgactggtgggaaaaactgacagtttcctctttgcacatgtttaacatttggctgttataatatatggtcctcggttggggaaagatacttatgatgaaggatattttttaatttaacttttttttaaatattggtaataggtcggcaacagcaactatagaagtacaactcaatagatggcattaaaacatattgtagtgtggatatatattttttcttttttaaaatgtgatattgacgttttattaatattttttaaattgttacgtttataaatttggtacttaaggcacagccagtatgagacactgaatgcgacatttattataaagagctgctgcactcctatttttataaattttactaacaaagtagactaatgtagacattcacagacatggtagggcaaaagcatcttcaaactaaagactccaaaatgctaactcagaaagaaagaaaaaacccgttttcaattctaatgaaacagcaacaacattttttttaattaaaaaaaaaatcatgttctttgtttttctaataaaatgttaggttgtttggtgaggtttttttgttgtttttttcctttctttgtttcttttcttttcccccaaacaaccagattaaatgctgagcgcttttaaaatatcaaaacttgttcaagtcataaaacaacaaaacataagttttatttaaaaaanaaaaaagaaagaaaaaatagtaaattcccagaaattcagtgtttagacgagggaatttaattcctattttgtccatgttggtgatgtactgtacttcccttccttttctctgcatcccccatcacctcatagaagactctttgttgatcattgtatgttaataatgtataaaatggctatcttgtaagcgtgctgtcctggtactagtgtagcgactttttttctcctctttcttctagtacatattgataggtataacataattaaggtttaaaaaaaattagacatagttattcagatttaggaccagtaaggatagaactttctcttatttatgaaaaaaaatgctaataattttggggcagttttttcctttaattatttttttcaatttcaagtttaattttattttagctgatctgatgtggtttcaactaacccaaggtctcaccatgttaaaatgccggcggactctacggcgttttgtagatccccccccccccacccactgtgaaggggtgccatactaccttaaatgctaatgctagatatgcaaaactggatttttttaatttattttttaaaagagggaggcatggtatattaaaatgattttactaagagaaaaaatatttttttaagaatgctcagaagaaattgataatctgtgtgaatatgttttagatgtttatataccttttgaagagacccagtagcccatagcacaaatcttgtggaaatccgatatgttttaatgtggctacctaggtttaaggttcacgttagtccccccattccatctagaagtccattttgaaagatttttgtaaattcttttaacactgatgtttcagcctcgtctttgtttcagttaagctcaatggcgaacatgggaaccacctttcgccttccctgggggagaaaccctcttggctgatggcttttccccggaattatcaaacagccaccgggtgactttctggcttccagatccatctgcctgagacccccgaactcctctcctcccaagcagaggcgagtgagtgggcattagctcccggacccattcccggtcctagctgggcatggggctgacggagatgaccaagccttggtctgctctctagcagcttccacagacttggctcgtggccttccttatatccactgggaacaaacagcctcgcgctctataccaaacagcctcgcgctctatcccagtcgcccattagcttgattcaaacaaagccccagcaggcctttgcgtttttatccttcataaccttcatcttaatttgaacttgtagcttggactttaaggtagcatggctctattgctgtcaatttactgtttcactgcacagcaatcacagccagtgaatgttacacacatcttgctagactagtataaaaatcattgggtaattgttggttctaatgacctgaaaggtgttcagtttttgttcttggttttgttttgtttttgatttcttgggggtgggttttgcttgttgttccttttcatttgggggtttttggggaaaaaatttatttttggttccaaatagaaaaacaaaacctattttgatctttagtgcaaacgagggctagggacttagcctcctccaccacctccacactgcttcattctgccattcactcactgcagcatattcaagaataaagcaatatcgtttactacattttttattgaaggtcagccatgctttctgtattatattgcatatgaaattgtttacaaaagaaacactaactcatacttctctttattggttgcaagtggcacgcaggaacagagggagagtggggggctgnnngnggaggggagattttttnttnttnntcttgaatgtgcttcgcaagccaggctatcttccaaggaaggcagacagtgggagagcagagggactgactgcaggcaagcacattgaagaaagacactggcgggtttccccaccctcaccccaaagcagaaaactagcagacgtcagctcagccccgtcctgggcacagacactacacaaggagacgctggaagttaagcaatactttaatactgtaatatgtttgttttctttttctttcttttttttctaccaaaaaaaagtaagtaaactaaaacacaaaaacatataaataaaatccatccctcttgtcggggacctgcaggggggcaaccttaatccaaacacctggctatcaaataatcagaatgtattgtctcagacaggatttcagttccgggaggcaggggcatgatgggggagggggccggaggctgagagacaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtccagaaatcaatgtgtttgtctgacaaaaaaaaaaataaaat

SEQ ID NO: 277 - DNA, 3436 bp, Homo sapiens
  misc_feature: Incyte ID No: 2457215CB1
ccgccattttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggccgcagcgaggagaagatctcggactcggaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacaactcctcgtccagtcattgtggaaccacttgaacaactagatgatgaagatggtcttcctgaaaaacttgcccagaagaatccaatgtatcaaaaggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaagatctgatgagacgacaggaagaattaagacgcatggaagaacttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatgcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaaaacttgaaagtaagaaggtttagtaactgggccgggcgcggtgctcacgcctgtaatcccagcactttgggaggctgaggtgggcaaatcatgagatcaggagttcaagaccagcctggccaacatggtgaaaccccgtctctactaaaaatacaaaaaattagctgggcgtggtggcaggcgcctgtaatcccagctactcgggaggctgagccagcacaattgcttgaacctggagatggaggttgcagtgagctgagactgccactgcactccagcctggacaacagagcgacacttgtctcaaaaaaaaaaaa

SEQ ID NO: 278 - protein, 707 aa, Homo sapiens
  misc_feature: Incyte ID No: 2457215CD1
MSRDRFRSRGGGGGGFHRRGGGGGRGGLHDFRSPPPGMGLNQNRGPMGPGPGQSGPKPPIPPPPPHQQQQQPPPQQPPPQQPPPHQPPPHPQPHQQQQPPPPPQDSSKPVVAQGPGPAPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGRSEEKISDSEGFKANLSLLRRPGEKTYTQRCRLFVGNLPADITEDEFKRLFAKYGEPGEVFINKGKGFGFIKLESRALAEIAKAELDDTPMRGRQLRVRFATHAAALSVRNLSPYVSNELLEEAFSQFGPIERAVVIVDDRGRSTGKGIVEFASKPAARKAFERCSEGVFLLTTTPRPVIVEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMRTERFGQGGAGPVGGQGPRGMGPGTPAGYGRGREEYEGPNKKPRF

SEQ ID NO: 279 - DNA, 6384 bp, Homo sapiens
  misc_feature: Incyte ID No: 201395.4c
aaaagtcacaaagagatcaagactgtttaatagttacttttttgagggaaatccagtcacatttgcctgtaccattacatacaccattacttggacattcacactcaattgggaacataaattacaaaagagagaggaacttttaaaaccacatttaatttttaataccaaatctgttgcactattacagaagtgaccctttcatgcacagataaatttcgcatctaccagtatggaagaggaaaaaatgtagttttattgttctcccaaaatattggcaaatttaaagtaacttttaatctttgtgctctctgatgccaaggcaaacctgttttgtctttttatattttcaagagacaggtggatctgtgaaaaatgaatatagagacatgaaagtatttagggccatctttacctgggattactttaaattatgctttacctacatatatcaaacatgccaggttactaggcctactgtgccccataggcaaagctctgaagatttcatcgaaaaatctgctgtcaatacgtagaaaagttcactatttcagtttcacagcaaaaaaggtggggggaggggggaacccaatagatatttaagtagatgctttccaatcccattcactgcattaattagcttacctcttatacagtacaacataaacattgcatgtttatttgtatgtaacacctataagcatatagcatctacattttaagtgtatttacaaattcaacaaaatatctacatataaaaagctttacttaaaattaaacttgatgcaagttatgagaaaccaatttattggcaaatgaaactgagcattccttcaaccataggttgttatagattttcatatttggaggtaacccatttgatagatattgtttatgaatacgatagaatatatatttactttttaaactgcagatgtaatcccttggaccgttggccttttaagcacttgcctgatttcttagattctgaaatgtatccataacaatttgcatacacgttgtttaatgctgcagagttttgaacacttacataggtaaagtcttggagaataatatattactgttggcatgctgttgtatgcttttagtgttggaataacttagttttaaaattaattttctagcatgttgacatctttcttactgcatgtaatagaaaccataaaggaccacaaaatcatcatgtgcttcagttggcaacaaagattttctttttatgcttatgaggaaatgctatttctaataaactgtcttatttttattttcatgtttccttcttttcccagcattgcagttttcatgaactctgctttttaaaagttacttttagacaatgacagtaatctaggacccagaatggactggaccagctgatacagaatgcacgatgttgtggaatgcttaatatctgaaggcactgtatgtgtcttgccctgtgttctctgaaataatgtttgaaatttaatttggatgatttgtttttgattctttcagtatggcacaaatgccgaaatgcactgcaatacacattgtttatgcctaaaaacaaccgaacatagaaatgatgtaaaaagtagaacactgtgctgctgtaatgcctggaagattaagaagcctacggagtaacaggagccaagagtaggtaatagttctcagtaagcatcagcaatgtgactgtcataatgaactcatttagcaagtatatactgtacaaactgttcctaacagtctcccaaaaagactaacgacagctatacatagtcaccaatttcacaacaatgtccacaaagacattgaagttctagagaatactacagtaacactcttgacaatgaaaacggaattcatatataggggttcagctgagggtagtataaacaaagtatcaaaccatgttttcataacatacacgggtatgtcctttaaatgtggagcatttttcatgcatcatattgaactgtatcctgcagaggaaataacaggatctgttggtgatgttgcattattttttatcagttctgaggaaatcaagaatacccattttgaatgaaaaagtatgcactttgcattccagttcatattaacatatcatttgactgagttatgtttttgctgtaactattctcataatactaacatacagcagaaaatatactctctacccatatgttcatagtatgagagggctgacaaacaagtgcttaggataaacattctagagaaatggaatattggcaaagagcttaaaaattaaacaaaggaattcatggcgttgacaggagaaggtgcctctgagctttcgtttccttcagccggctctttctctttcttaccactgtattgtccaataaaggagccatcctcattgaactggccattaaccccttctccatagtcaactaggctgtcgtcactatcttcttttttcacagtcctgtctgaaggagttcgacttccttttttcaaaggcttgtggtcttctgcatcactgtattctccaaatgtcccatcatcttccttcataggctggatttcagggtcagcatgggcatcttccttttctttaactggatatttaccacccttgtttcttctgatgaagcaaacaatcagcaaaattaagataaggagagcaacagcacacatcagaccaatgaaccagccctgagttgcaatatccacctgccggcttgccatcgcttcatccacagttgttactgcttcctctgtaatttgacttcctgatcctgctgatgtttgtgcatagaaataaaacttatatcgagtgctgaaatttaaattttttaaagtccaccgtgtcttgttggcaggaattttcaaatctaccagagggcctaattcatgtgtgctgttaattggctgatactttaaggtgtactctgtcaaaatgccattcgggtggctcggtggatcccattccaaagtgagagagtccagtgttggattcacaatcttcaaagacgagggagcactggggactccttctggagtattaaagactctgtcagggctggctgggccctcccctttcccattgaccactcggacattcagtgtgtagtggctaaagggctctagccccggcaacatgccatgagtcttgctgccttggaaggtgaggatctttttctcaatgtgacgtctgtttcttttagatgaactctgggtcttccaatagtaaatccgatagccttgtaggtgtcctcggatgcttttcagaggtactgggtcccagtgcacctcggctaaggtactgttcaccacattcacacgcacgttcccaggagccaccattgggaggtcttctccagaatgtcccatgactacagctggctcgggggcaaaccccatgtcattcagggcctgaactttgatcaggtatggaacaaaggttggcgtgcctgagacaatatatttggatacatttgccacaaccacagatgtccattcatcatcaccatctttctggcgccagctaactttgtactgaaggcctggcccattagattcgaaaccattcaagggcttccacgtaatcaccaaattatcaggctctgatcccagtccttccacagctgtggggtttttatctggttctgaggctttcgtcaaatactgctcagacgcctcgctgggcaagctcttcccaatgctgttcactgccatcacgcggaaggagtagttcacgtaaggagacaggttcagctgggctgtggtctgtgttccagaaacttcagtttggtggtgccacagccctggcttgtgcattgcatcttcatattcgatgatgaattttgtaatggggctattgttgtcatcgcctggggtccatgacagctgaacacttttgtcaagttgatctgtcagttctaagtcaaagggaggatttgggacatcgtaaacgggagctggagttggagtaggagcaacaacgctaagcacagcgctggcggagacgctgtccagagtggtgttggccacacacgtgtaggtcccgctgtcatcgtcactgacatcagctaccactagatgatccttgtcaacagtgaacctttcatcactgggcagttccctgttgtccttcagccacaggacagtgagggataaggtgtgatcatgtttcactttgcattcaaaggacaccatgctccctctttgcacaactgcatattcgggctgtttaacgatccatgtagcatctttgatttctaagtgaacttcattctttgccatccctaatttattccttgcaacacacgtataagttcctgtactgtccttttgggccacaggaatttccaaagttccattttcatgtaaaacataaatatcttcatgaagagcacttcctttagctcctttaaaccactcgatggttgggagaggagacccaaagaaggcacagtctagtaaagcaggcctgtttgcaatgacctggtagagtgtgtttgcaggtgtgaggattcgtggtggctcagccagcacatttacaaatgcgtttgccagtaaatatccatattcattagaggcattgcactgatagactgcacttgatctttcttgaacatttgaaaaaataatggtatcgccatctatttttctgctggggtcatcaggggcaatttctattgggactccatttgttaaccagctaattctgggtttggggttgccattagctctgcagatcaaggtcccatcctctcctggggacagcacaagattttgaggggctgtgatccagtatggagccgctttaactctaacagaaatggtatggtggatggctcctaatgcattttttgctatacattggtaatttccagagtctgcttctgaaacatgaatgatctgcaaggttttctcaaagttcttataaactgtcctgtttttgggtagcattccatcttcctttgcccagtaaataattggggtaggcagtccttctgcaatgcactccagtgaaagcacatttcctcttaattcctctttgttacttgcattgccttctggagttaaaaatgttggtggcctctctctacttgatttagctgaaatcaccttcacagaaataggttgcttctgctgtatggtttgagtatgattaaatctagcataacagatatagtcttcgcgggtgtcctctgggaggacattggaaaaataaaggtccccattcaaaccttgagaaactctctcactttgtggaagtctttgaaaggaattatccatccaaaatattataggtggtggtaatccaattgggggtctgcagggaagtactaaagactgaccactttgaagtgtgattggttcaagtttttctttggtccacaatggtgatctggatgggcggacaacaatgttattagaaactgcagctccgcgttcgttccttgctgtacactgatagactccttcataggtctcagctttcccttcgctcatgatgttaattatgagcgttcctgtgccaggcttcatggtgaccagagggtctttatcgatgtcaaaatgagtcccattacgggtccaggaaaagcttgggggcggtttccctttggcttcacactggattacaatattctcccgagggtcaataatgtaatcttttggagactgttgggtgatggttggaggctgtaccaagtcttcaagaagttttggatcaagaggtacttccagtgcactaatcatctggcacaggaagagaatcaggggcactctgcccgcagataagcgcttctttttcggcattattttaagctgcattagcttaactcctgctgagactcacacactgaatttccttttcttctttcacaaaagattttgtgaaacgttgtgtgcaagtttaagtaattttcatgcgggaaactttgaagaagctcttaagttgttcttccttttaattctttaaaccaaacgtcttcttagcattgctcttcagaaggtccactgggctagacacctcccaaatgtttttctgatttctgaagctatccttttctcaggagaatgccaacagctaagaccagctttggtcgaagtcttcagcaaacaggggataaagaatgctgagagagaatgtcacaaagattcgttctcgcgccgcgccctccgctcagctctggcgcgactgcccaggaccctggaccgccggtgtcctccgttctcgacgaagctatcccctctggctgctccagccaggcggcccctgcgccgtcccccgcgcccgcgcgtctgaggctcggacttcggcgcgcgtccgccagcgacctggcgaagcgaggctggccccgcgccggcgcgcgcccccgccgctcccgccctctccgctcc

SEQ ID NO: 280 - DNA, 1619 bp, Homo sapiens
  misc_feature: Incyte ID No: 233189.21
  unsure 1586: a, t, c, g, or other
atttagactgcccttgtgtcagaatactaaggtgggaggcggagcggaggtgccagtcactctgggcgaggccttactgcgcccatgcatcccgggcccatttgtcagcccttgctcttcagtgggagcccagctgcaagcccagagtctggccactccatagtcctgcacccctcttttgattggtctttcctttgcccagagaggggctccagagggagataggtggtgaagctcatgcagggattctgaggacctgatgggggagggccctgcgaggggtccaagcctacatcaagaggaattcagtaccagggggagctccccaccaccccggaaaagggagaggcccagagatggaggtggcttgtccagggccccacagtaagttgggatttggagccagatgctctaagcccagcccttccgtttcctagctgggtgtcccttggcagatgccacctttggagcctgccccacctcgggacacagcgagcttcgagtgcggtcagcccctgtggagtgtgtcccagttacacagaaatggggaaaatttcacaaaactaaaaaatggcttctcagccctcctttttcagtgaatgatgtggagccccacgcctagaaagcctggtccatgggcgagagactttgctgagatgagaagccagctggggctgctgcccacccaccctgcccaggctcctgaaggtggcctcaccttccaggtgcttgacaatgccccgcaggctgttcccgtgggctgcaatgagcactcgcttgccggccttgatctggggaacaatctcctcgttccagaagggcagggcccgggcaatggtgtccttgaggctctcgcaggtggggagttccccgggcttcaggcctgcgtaccgacgctcctgggggacacaggcacgctgctttccctcccaagccagtgggcccccacccgactccccactctgcagcttcccagaggccttcccagcaaaggcagcccaccttgctaatggagttgtagtaggggtgcttctcgtccatcgggggcggcgggatgtcgaaggagcgcctccagatcttcacctgctcctccccgtgcttggcggccgtttctgccttgttgaggcctgtgaggcccccgtaatgccgctcattgaggcgccaagtgcgcaccacaggcagccacatctggtccgtgccgtccaggatggcccagagggtgcggatggcccgcttcagcactgacgtgtagcagatgtcaaactccatcttggcatccttgatggccttggctccccgcttggcctcctcggtccccttttcactcagctctgcatcgaaccagccacagaaacggttctcctggttccatgtgctctcgccgtgccggaccatcacgaggcgccaggctaggaggcggccctcagcaggcagaggaggagagccagaggagctggtgcagaccacagctttgtggagaggagtctggccttgtggaaggttatccaaaataacccagtgtatgaaaaccaggaaaatcttaacatgggagaaaagaagatgatcaatacatgcccatcctgagntgattcaactattggaatgatcagatacagatt

SEQ ID NO: 281 - DNA, 566 bp, Homo sapiens
  misc_feature: Incyte ID No: 196606.6c
  unsure 17, 22, 44, 80, 103, 120, 124, 129, 141, 148, 171, 215, 235, 268, 300,552: a, t, c, g, or other
ttgaagtagttggggcntatgnctcttggatagacttatccccntatagccaatgataggtttataaatatgctgctagntcatatgtccaatagaagttctncgggaagaagcatgtgnctgnttatntgaagttgtaantacaggnatggaccctgttgataaaatganactagtggaatctttgtgtcaagtattacagtctgctgggtttntcagcattgaccaggaagangatgttgacttcctggccagattctctaagttngtaaatggaatgggacagtcattgatagttanttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacaggtaagtttttgttttattctttttgctcaatacataatacaaaggagccatggagaagtggaaaatatggaaaaattaaaaatganaaaatacccataat

SEQ ID NO: 282 - DNA, 3924 bp, Homo sapiens
  misc_feature: Incyte ID No: 196606.8c
  unsure 269, 271, 273: a, t, c, g, or other
ccaccacgcccggcctggaattttaaattctatcaacagattcacataggctttttccagtacattaaagaaaaagactctcatataacagaactaagttgcatgttacctttgaggagtgaggttaaatgaattaaagcatccacacactcatatttgtaaacctttaaatgggaaattatggagagattaagatgagaaaataaaactaaagtatttataataattccagaaaagacttggaagatttcactacgtaaagtttattntnanatatatatataaaaaaaagtataacactggagcctaaaaccattctcttttgtagaatacatattggcgttgaaacagtttaaagaaatgaaatggctatctacaaaaagttagttttgattgctgtcttcccccatactttgtgtcttcacacataaagaaaattttcaaagattttatattcagcaattttttaaaaagtacactgttttccactgctatggtctttataaaggacttgacttaaaatttcaaataaaaaagaattaaggttctaggataactcttgtgtcttttaagagcatctttatacagaacaatttggaccggcatgcaggcaacttcttttgttgttacatacctgtattaggaaaattacacccattttacagaaaaatcccaaaacatatactgcaataagctcaaaacaatgtgaaaaagaccagtgtgaatggcacacaaaaatcgcctctttataaattaactggaattcatgatcatgaagtaggcacagggaaatccagtcctcagggctttgctctctggaagaacacctttaagtaatttttaaaaactttagcatcaggctgctgaagcgcttgacaaaactcctgaattatttctggagctacttgcaaggagggcaggtattcttgttgaagatactgaacacattctgggccccgtttgagatgaattgttttcagtgtcactgcacactcagataaagccaatactgtttgtgcatctgccaggtcaaaggtttgttttaaaggtgctaggaaacatgcggggacaatgtgcttataaacaaaatcagcaaatcccactggtccatctttacctccccagagttctaccaactttgagaggatgataaaacatgttttctgtgcaattggatctggatattcaactgctccttggataacagtaaccaacactctttctacattctctgcaccttgatttgctataacttcgctcatcccactgcctgtgactgtttgcaggaaagcaaagtaactcctccgcaacatctgcttctctaaagcagcagactggtcattttcttctgctggccggagcagcacttcaaaaattgcatgaagcaggggcatgaacatctgttgtaaaaacggggatacctgtatcttgaatttggccgtaatctggttgataagaggaatgaactcctggagatcttttgcttcacaatctttgagcatatgttctgaagcagatggaatgaacggaagaacttcttcctccaggcaaataatcattcgatgaaggaaagtacggactccacttctgagaatatccttttgtaagggacaactgagggctggcaagaatgtctgtaaacagtccagataaacttcggaacagccacattgtttcacagtctgtttgttgctgaaagctttactggttcgacttgcaaatccaacagcatggttaagacagtctgctagcagaggcttgcctttcttcatcttgtgccagcatcaacttttctaacagaattttaaacttctccattagtggagtcaacagattcctcattaaggcttgtttcctttctgccggatattcactattaacaatcagcactccagctgtctcataaataaaaagttgatcatcgctgctcagtaaggactggtggccattctcaggtggagaaagctctaataaatcttgtattctattcaaaatatcctcaatgaaaggattcatttgcttattgagagatttgacaaatctagaaaacaggtaagccgtcctgctccgaacttttgcactggaatgccgcagacctctgtgatctaagaaagccattagtacacatggaatgtgctgaggttcaactgtgaaaaacttttcatatctaacaacagtttcgaagaactccaatgtcacagatgtatgctgataggaactgactcctgatgttaccagagttcgcatcatatcctgcaaagcactagcttttgaaacatcacctgagaagtgagcaccatgagatactggaagagcttctgccaacatatacagcaatcttattgctacttcaacttccataaaccgtgtagtctgccaattctgcagtgtagaactaaaaactctgcgaacagaggccagtagtaactctggtgaaacttgagcaagcctgtccaacagtaacttcagttgttttctatattctacaaacatggcttcatcttcaccctcattttcaaagttatattcttcatcgtaagtcaattttttcataacggccaacatgattgcctctacattagctttttgctgatccgagagcactgtaagctgtttcaaaatatgaagataatcgtaacaaaatccaataatattagaagaaatatcatcatcctcatgaattagtagctgcaacatcagtgccacttttgtttcaatagcttgtagtgcctcttgagcattcttaatatccccattcttaattaatttactccaactaactatcaatgactgtcccattccatttaccaacttagaaaatctggccaggaagtcaacatcttcttcctggtcaatgctgaaaaacccagcagactgtaatacttgacacaaagattccactagtttcattttatcaacagggtccattcctttatttacaacttcaaataaacagtcacatgcttcttcccgtagaacttctattgacatatgacctagcagcatatttataaacctatcattggctataagggataagtctatccaagagacataagccccaactacttcaaggcactgacacgtcacttcagaattagtaaactgataattttgtaatatttggtaccatgattccaccagatttggaatgcactgttccctcatggtatcttttatgagagtattcctacgagcctcctctgatgtatgcaccacatcacgatccaccaactctgaatcaatagccatgaggattcgcaggtagagatctactccccttggatttaggtccactactgagagaatgtcaaaaaaaaacttgggccacttagtgagatactctgtaacaaaaagcaaggcgaagacttgggcggctttatttcgtataaaggtcttctctggttggggattcagcatctgagcttgcagccatgatatgagcgtctccctaattagctgttgttgaacagtggttagttctgagtatttgtatttaacttgatgttccagtacttgaaagcagaaaaacttcacatgatcatcactgtatgtcctctgggctagagcttctgcacacacctgccaggcatctggggaaatttttaactgctcaaaataggccagggccctttgtctaaagtctgaatcagcatttggatttagccctaatagagcctgttcatccatcctcgctgttatacttgtagttttctggttgtaataggcgtgccctctgatcccacagaagaatttataaacatctgccacaaaaaacaaagttgaaagaaaacattacttgataaacaaatagatgcttatcctgaataacgtaaatggataaaatcatgcaaagaagcttaaatgtttaaaaacttattttggaacttatctaaattacaactaaaagttagagcctaattc

SEQ ID NO: 283 - DNA, 1205 bp, Homo sapiens
  misc_feature: Incyte ID No: 1040190.3
gtaagttccgtttttagccccggcctttttctagccaggctctcaactgtctcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggtgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaattcctgaagttgtcccaaatctgtcagacagtgcctgctccatcagctggggagaactggaatctggagacacagaggggagag

SEQ ID NO: 284 - DNA, 1393 bp, Homo sapiens
  misc_feature: Incyte ID No: 1427459CB1
tttgggggtgataaaaaggggggcccaaaaaacgggggagcggagatttttttgggaaatttttttttttttcctttggatatatgaccagcagtgggattgctggatcttacgatggaattcccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaaaaaaaaaaaaa

SEQ ID NO: 285 - protein, 247 aa, Homo sapiens
  misc_feature: Incyte ID No: 1427459CD1
MEFPKMLTRKIKLWDINAHITCRLCSGYLIDATTVTECLHTFCRSCLVKYLEENNTCPTCRIVIHQSHPLQYIGHDRTMQDIVYKLVPGLQEAEMRKQREFYHKLGMEVPGDIKGETCSAKQHLDSHRNGETKADDSSNKEAAEEKPEEDNDYHRSDEQVSICLECNSSKLRGLKRKWIRCSAQATVLHLKKFIAKKLNLSSFNELDILCNEEILGKDHTLKFVVVTRWRFKKAPLLLHYRPKMDLL

SEQ ID NO: 286 - DNA, 4971 bp, Homo sapiens
  misc_feature: Incyte ID No: 480453.16c
  unsure 322-339: a, t, c, g, or other
ttttgtttaaaaaggctttattcattttttgatcagggaaaaggacaatctcaatgtcaactcgtcacctaatcataaatttgaacttacaggattcactaccctagacaccgcacctactgacaacacaacttaaaaatgaacttacttccattccctaaagttgcatgttgaatgaacagaatcccttctaacagccaacattggtacttggcctaagtttaagaatagcaaaacagcagcaaaaaagaggccaagagcattataatgtgatagcccaggaagtagaatcattgttaagaaagttgcaggcaccaaattnnnnnnnnnnnnnnnnnnctcatgagcataagaaacttaccagttttgtgagatcacccgttgcgtgagatcaactactctgcctgtgaacacgtatgccaatcccagtaaataacactgaggccaaggtcccaaaatccaactacactgaatgcaaaatccaaagctttttattattccaggtcctctgaaacctggatataaaacggattcttttcaatgcacccagagggtccactgtaatgactcagtcacatttgtaatgacttagtcacatttgtaatgactttgtcataaccaagataccttttccactattcctttctgaatatgtaaatatttaactacttagttcatgcactgtgtcaaaaactagatttactatcaagactttttctaaactcacagagcattaacagctaatacaacttcctcaggatgcccaaacagaaaacattttgttcaatcttgtggcggctctgagaaaacacaactaaatcttattttgccactattttaatttttcgaccaaactcatacctttctaccaaaatccttgagttgtaactacttccaatgctcttaaaccatagctcctaccagttttacagtgctccttttgtatctgaacttttatcaagaattactcattgtgttatgattacaaagctttttctaggtgaccactgattaaagccaaagtaatcagcaattcaaaaatggctttccagagacaggaacaaagtaaaaggagctactaacaattttattacaatccagaagaaatatggtctactagaaagcttctactaatcacaacacttatgtcttcctttcaggacagtcttcagataaccagaagggaaagaacattgttcaaaggtgtggtagaaatctcagttacagggagaagatgaagccttaagagcataaaatacacctacaaattggagaagagggtgacgctggctggctatttataaaggaccacagtttctctgtatggaccaatactctacaaaatcaactgtgccttaattattgcttattttaaattacattttttacagagctatgtagtacctgacgcagaaaagcaatcacataaggaagcatttatttgaggtttaacatgaaatgatacaaataaaatgtgtataaacaaatccacattgagtcataacacagatagcaaaggacaaagtaaaaacaaagaaaactaattggcagctatatacagttggacacaatggtgtcttgtacactagaaagtcttttacaaaataatcatcttagatcaacagaagaccaatcttcaatgtcgtcctgcaagatgggttactttaacatctcctcctaaaaacaaaaacaaaataccagttagatttgtgcaactctgacaagcttttaaaggtccactttcatgaattgttttaagtcctcactttattttcttcaataattaaagatcatatgcatatttattggtaaaatacagtttgggtagtcaataaactcaccctggagttcccaaatgacattaaattcaaatctattcaggaaagaatctgggaatacaaccttcccatattcagaggttcaactatgctagattaaggtctactagaagcatctctagtaacccaagtaaaatgctatcacaaacaccaatttctaataagtttattacaagaacataaattgatctgtgcatatgatctttaatttatatcccagatttaaaagttcttgttttggtttgtagatttcactattagctataaaaagaaaaagcaagcattaaatcttaaaagaatgaacacttaaaatgaggctccacaattgaaatacaacactaaacagaagaccaaaatgattaagctgtaaaaaggcatttatgtactttaactcctgtaaaaaaccatttaagttaagtttagacacttaatctccaaaaagattaaaaatgaagccaaagtctgaagttttccactttaatctttacgctggtacatgaagttggaagagaccataccacaggacagcgttttctggtgtatgccttgcgctctgcccgcaacgtgcgacccccagagatagacgtggtcagggtgacacacggcctgcaatgaagttcccgctggcgggtacaaacaaggtataatgtcagagttagaagacaacattcttgttttccttaagttgtacccatttcagtactttacctgttaatagttctaaaatgtttaattattcctctagaccacctggtacacaaaagcaaacagaaaaactcttaagtttttctgcaatactaaagaaagtgagataagactttaaagttaaagatctatagacactttaggcaaaacaggctcataaagcaattaaaaaatcaacaatttagtaaaaacaggctacatagtattttgtttttacgtttcatttgtctattgatctttaaattaaattagacatttctactgttttcctgtactcttatacacacctgttttctccaatgttctcctttagtatggctggtaattgttttggtgattgccaccccctcgagatgccttgccataagtgctctgttggccactgtagtctgcatatccctgtccatatccatagttcccatagttatacccagtataatcatatccgccatagcccactatagttttgatcaccaccataggcactattgtaatttccatatccttgatcataatagttattaaatccttggttccagttttggccctgacctcggccacggacccctcgtaccacctcgtccaccagctgcagcacctcttccacctttttgttgttgctgttgctgcctatatacctctttgggttgtgcaactttgatttcacactataaacaaaaaacatgaaagtataatttttaccgaagttctaaaattaaatcattttatttttctccacatcaagaaattatttcaattatttaaattttcatttaaagtgcttaaatggctttaccttcccagaaccaatttgatggtatctgctttctaacaatttttttactggctcttcatcagtatatgtgataaaacaaaatcctcttctttcatttgtttttgtatccatgggaagttcaatattttcaatctctccaaggctccaaaatattctttaatttgttcttcagaagtatccgggctcaatccacccacaaaaacctttttgggaggttctttcccttttaaagctttggcccttttgggatctatcaatttgccatccagtttgtgttctttcagttccaaaaccttatcaacactagcagcatctttgaaaagcacaaatccaaatcctcttgatctcccagtgactggatctgttttaattgtgcagtctacaacttccccaaatcgagacaagtactctgtcagatcttttttgcttgtatcccagctcaagcctccaataaacattttaccgtcatcctgctgattcttgctcgcgttgatcttggatccctctgcgaattcctctatattgctgtactcgttcatatcctccatagtgacggagctgtcggccaggggggttgctggcgcgcagtccgggtcgcggcagcagcggcggcggagcgttgtatggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggtttgggaactgaaagaacacaaactggatggcaaattgatagatcccaaaggggccaaagcttaaaaagggaaagaacctcccaaaaaggtttttgtgggtggattgagcccggatacttctgaagaacaaattaaaggatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaatcaattaccagccatactaaaggagaacattggagaaaacaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcacctgaccacgtctatctctgggg

SEQ ID NO: 287 - DNA, 522 bp, Homo sapiens
  misc_feature: Incyte ID No: 1095604.1
  unsure 271, 283: a, t, c, g, or other
aagacagcacagacagattgacctattggggtgtttcgcgagtgtgagagggaagcgccgcgggcctgtatttctagacctgcccttcgcctggttcgtggcgccttgtgaccccgggcccctgccgcctgcaagtcggaaattgcgctgtgctcctgtgctacggcctgtggctggactgcctgctgctgcccaactggctggcaagatgaagctctccctggtggccgcgatgctgctgctgctcagcgcggcgcgggccgaggaggangacaagaaggangacgtgggcacggtggtcggcatcgacctggggaccacctactcctgcgtcggcgtgttcaagaacggccgcgtggagatcatcgccaacgatcagggcaaccgcatcacgccgtcctatgtcgccttcactcctgaaggggaacgtctgattggcgatgccgccaagaaccagctcacctccaaccccgagaacacggtctttgacgccaagcggctcatcggccgcacgtggaatga

SEQ ID NO: 288 - DNA, 11928 bp, Homo sapiens
  misc_feature: Incyte ID No: 241291.28
  unsure 10422-10464: a, t, c, g, or other
ctttacctcttgctttgcagccttctctcctcacagccttcctgtggctgtgtttttggccctgatagccccatggcacaactgcactttgcctcacctaggcctgtggcttcttgcctggcaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgagcacatacgttgtcgacaggaggcggagcttgcaaggatgggctttgacgtgcagaacgtctggagagtctcacacatcaacagcaactacaaattgtgccccagttacccccagaagctgctggttcctgtgtggatcactgacaaagagctggagaacgtggcttccttccgctcctggaagcggattcccgtggttgtgtatagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttgattcttctctgactgcgtgctctggagtggagagcacagcagctcctcaaaagctgctgatcctggatgcgcgatcctacacggcagcagtggccaaccgggccaagggtggaggctgtgaatgtgaagagtactatcccaactgtgaggtcgtgttcatgggaatggccaacatccatgccatccggaacagctttcagtacctccgggctgtgtgtagccagatgccggatcctagcaactggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgagcgatgattttacatgtttgaaggagtcagatggcagtgatactgaggattttggctctgatcacagtgaagactgcctttcagaagcaagctgggaacctgttgataagaaagagactgaggtgactcgctgggttccagaccatatggcatcacactgctataactgtgactgtgaattctggttggccaaacgaagacaccattgcagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcctttcagagctgttgtgggtgtaagtgacatgatgtggccaaaaatccaaactgtgcagttgcgttgtgacaaacatgcaatgtgctgtaaaaattcaatacagtttaaataaaatctctatattagaggaagcagattgtcaaattaagggtgtcattgtgttgtgctaaacgctgggagggtacaagttggtcattcctaaatctgtgtgtgagaaatggcaggtctagtttgggcattgtgattgcattgcagattactaggagaagggaatggtgggtacaccggtagtgctcttttgttcttgcttcgtttttttaaacttgaactttacttcgttagatttcataatactttcttggcattctagtaagaggaccctgaggtgggagttgtgggggacggggagaaggggacagcttggcaccggtcccgtgggcgttgcagtgtgggggatgggggtatgcagcttggcactggtactgggagggatgagggtgaagaaggggagagggttggttagagatacagtgtgggtggtgggggtggtaggaaatgcaggttgaagggaattctctggggctttggggaatttagtgcgtgggtgagccaagaaaatactaattaataatagtaagttgttagtgttggttaagttgttgcttggaagtgagaagttgcttagaaactttccaaagtgcttagaactttaagtgcaaacagacaaactaacaaacaaaaattgttttgctttgctacaaggtggggaagactgaagaagtgttaactgaaaacaggtgacacagagtcaccagttttccgagaaccaaagggaggggtgtgtgatgccatctcacaggcaggggaaatgtctttaccagcttcctcctggtggccaagacagcctgtttcagagggttgttttgtttggggtgtgggtgttatcaagtgaattagtcacttgaaagatgggcgtcagacttgcatacgcagcagatcagcatccttcgctgccccttagcaacttaggtggttgatttgaaactgtgaaggtgtgattttttcaggagctggaagtcttagaaaagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggtcgatattaataatggcaaaatttttgcctatctagtatcttcaaattgtagtctttgtaacaaccaaataaccttttgtggtcactgtaaaattaatatttggtagacagaatccatgtacctttgctaaggttagaatgaataatttattgtatttttaatttgaatgtttgtgctttttaaatgagccaagactagaggggaaactatcacctaaaatcagtttggaaaacaagacctaaaaagggaaggggatggggattgtggggagagagtgggcgaggtgcctttactacatgtgtgatctgaaaaccctgcttggttctgagctgcgtctattgaattggtaaagtaataccaatggctttttatcatttccttcttccctttaagtttcacttgaaattttaaaaatcatggttatttttatcgttgggatctttctgtcttctgggttccattttttaaatgtttaaaaatatgttgacatggtagttcagttcttaaccaatgacttggggatgatgcaaacaattactgtcgttgggatttagagtgtattagtcacgcatgtatggggaagtagtctcgggtatgctgttgtgaaattgaaactgtaaaagtagatggttgaaagtactggtatgttgctctgtatggtaagaactaattctgttacgtcatgtacataattactaatcacttttcttcccctttacagcacaaataaagtttgagttctaaactcattagaattgttgtattgctatgttacatttctcgacccctatcacattgccttcataacgactttggatgtatcttcatattgtagatttaggtctagatttgctagctccaagtaattaaggccatgtaggagagcatggtaaccacagatagaactggtattatcccaagtggtctgcagactgctgagtggggatgggatctgctctctgttgagagttggtaatcattggtttgaaatgtgatgaaaccactcaagccaatgaaggtgggtgtgtaggtggggagtactttgccataatattttaaaacattacctggttagagttctaagtggtacttatttttgtttggttaggggaaagcctgaataaaaacagaaatggacacataatatgcatattccatagtctttgggaggctggaatgtgcctgggatttgggtctaagtgtatgcgtaattcttacctcactaaagaatttgccttgtttttttccttttggtgagtgactaaaacgtctgggcttccctgtgtgcgtgctacagtaagcaagcagaggctgtgcaaaggtgtgagcaggatcacgtggaatctggaggatacatcttggcttgcaaactgcctctgtctcctgggtgggactgttctgtccttgcactgctgttctgtgttacctcttggggtgtaaggttttgcttacaggagacaaactttgggcgtagaatggaagccactgccagcctctgtgctgagaaggaaggtgcttgtttcaaagggagcagcaagggaggcttgttctactcacctgggcctgtttgcctgagaaggggagataagggctgaactgggactagccagggggaccaacacaaatggtgggggatcatgacctgaaggattctttccttcccatgagctgcagggctggttgccgtccttgcaactgtgtcttatttgcctgtgccgttatatcttggtgacccctccacgtgtacactactgacaaacgggtggagtgctggggagaagtcactgtgccgcccacctagtaaaccttctgtctgtgctcatggcatctccaagatggggcactgctgtgtgcagaatccagggtcctctttctgcttgcaactcctttccctggatgccccagaaacaatccaggcctcctttcctatcttacccctttgctttgctttttaccccagcacctctataaccgccttctcttcttttcagaactccttgtttctcatcctgttttttatgattacaaaactcttgcttccaccctggaagataactgctatagatgcctgtatgtaaatggtgctgtctccagcaactggcatgctgaagaagaattgattcacggggtataaatgttggggattggaagtggggatgaaatggcacttgttgatacaggagcagagaggtgaggccgactgctgaagacagctcgccaccctccttgcctccactccaatccaggggctggggccacattctttgccttcatttatcctcagatcaggtgagatcgacaggaggtgttgatggcagtgccagcaattattgctaatccgtttgcatccttatgcatagatctgaattcagactttgtgaatttccagaggtgtgggtaatataatagaattcagtgagtgggcatggctgatcttgtgcaaattaaaagttatggggcataagaatagcaaaagttgaacttcttttaaaaaggaaagtaccctgagagccagtattggttgaggctcttcagtatgcccaggttggcagcactgagaaccgcaggaacggcctgttgttacaaaaaggagattgactcagctgcccttggtgcatctgactgactatgactgctgagagattccaaggacccttaatgccagggctaacctctccatgtgcagtgagacctctggaggaagtgtcatcctctggctttgtgtggtactcattatggtgcagtgcgggcatgaaatgaagacacccaaataggcttacagatacgatatgttttaaatgttcgtatttaacaaaaacatactgacactgtttggaaatggcaacaggaagatagcaaaatgaatactaacattacgaaaagatgaacaggtacatgttccaaggcaggtggctgtgaacttcctctgagtgaaggcatcccctccagcacctttcagcctgctagttaggacgacccgccgccaccctccaggacctccagccctgcactgcctttcctctcttttaaataattcttcattgagttctaatatgtaaaaaaaaaaagtttactgtaaagtttgcaaataaggaaattttttttaaaagtcctcagtaatcttaccagtaacaattgttatgggcacatttgcttttggaagatttcttttgtatgcatgggataagtacatttttaaacaaaaatgggattatgccataaattctattttgtgactttaatatatagtgaacaccttttttaatgatgacaggatgttcccttgcatggctgtatcaatttaaacaatcttgtttcaatgggcatacagggtattttctagtttttttttcctcttagaaaataatacttgcgatgactttccttgtagctcagactttttcacgtctgttgttatctctttgggaatgctgaatacatacatttcgagaaggaaatgactgttaaactcttaagacttcaggttcatattgctaaactgcccagcagggagggattttttcaattagtgttctcactggtgaggcaaacctgatgccttcccctcttcctcagaaccggctttatcacattgaaaacctttgctcctccgacggatcgagtctgctttccctgtggatgtgagcattgctttgtctgctggtgactgaacatctctaccatgtgtcaattggccatttgtgnnnnnnnnnnnnnnnnnnnnnnnnnnnnnnnnnnnnnnnnnnnattttctaattcctagtcatttttctattgattgttttgcaaaagccatttacatcttaaggatattgataatcctctttggtgtatttttgcgctatttttttcccccgtataaagggtcgccttttaattttgtgtttcaggtagataaaagttaaacgattttcttaggttagtttatcactgtggtttctgaacttgttatgtgtagatcttttccaccccaagagtacataaatattaatccatactttcttatggaacttgtatggtttcgttttttacatttaaaccttcttccccgtggtgtgtgttgtggaatctgtgtttgtgtgaggaggggcatggtgctctcagaacccacctcctgtggccagagagccctgtcctgtgagggtggttatcacagtggcagggttcaattcagaagaccttgagggcaggctgatgtttcctgaatgggcccctggttgttgcttgtccctgactctccatttccccatctgagtggatttggacctaatagggcactggagctggttcgaatcctgactggactacttggcaactttatgtctgggagcaagttacttaagctccccaaggctgtgtctgtgaaatgcgggtaaatgaatgtagatgtttggcagcagctactccttgttgagctctcacagtgaactctcctgcctctgccctccttccccgcctcccctggtgcctagcgtcaggtctagccacttcctcctgggcccctctcccttttctgtggctggctgcctgcccgcctggcgctggacctttcatgtaacgggaatcagcatgtatattctggtctggtctgtttctacacttaattttgtttccagtagtatttccctgtaccggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaacca

SEQ ID NO: 289 - DNA, 64 bp, Homo sapiens
  misc_feature: Incyte ID No: 230611.1
aatttgattgcattgatcgtctgacatgataatgtatttttgtcctctaagaagttctgagctt

SEQ ID NO: 290 - DNA, 571 bp, Homo sapiens
  misc_feature: Incyte ID No: 3993708CB1
gcgggtgaggggcggggcggggcgcggcgtatataaggctaggggcgggcgccgctcttttgtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaaaaaaaa

SEQ ID NO: 291 - protein, 44 aa, Homo sapiens
  misc_feature: Incyte ID No: 3993708CD1
MADKPDMGEIASFDKAKLKKTETQEKNTLPTKETIEQEKRSEIS

SEQ ID NO: 292 - DNA, 459 bp, Homo sapiens
  misc_feature: Incyte ID No: 1000133.12
gctgcagcaacgcgagtgggagcaccaggatctcggggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaacagaacaaaaccaaaaaatgtcc

SEQ ID NO: 293 - DNA, 5105 bp, Homo sapiens
  misc_feature: Incyte ID No: 400253.17c
  unsure 31, 1622, 1987-2279: a, t, c, g, or other
taggcaacaaacgagctctgtctcaaaactnaaaaataataaaaaataaataaacctctataaagtataccaagtcttagtttttaaattaagagataagtgtggatttgttttccaaaggtgaataagctttgttttttccagacaaaagcaagccgggaggctggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgtttccatcacacaatttgttacttcactgaatttcttcaaaaccattgcagaagtgaggtcatccttgaaaagtggcagaaaaagaaaatagcagagatgggtccagtgcagtggcttgcccactcaaaagaaggcagcagacaaagtcgtcttccttctttccaatgacgtcaacagtgtgtgcgatggtacctgtggcaagagcgagggcagtcccagtgagaactctcaagacctcttcccccttgcctttaaccttttctgcagtgatctaagaagccagattcatctgcacaaatacgtggtggtctactttagagagattgatacaaaagacgattacaatgctctcagtgtctgccccaagtaccacctcatgaaggatgccactgctttctgtgcagaacttctccatgtcaagcagcaggtgtcagcaggaaaaagatcacaagcctgccacgatggctgctgctccttgtagcccacccatgagaagcaagagaccttaaaggcttcctatcccaccaattacagggaaaaaacgtgtgatgatcctgaagcttactatgcagcctacaaacagccttagtaattaaaacattttataccaataaaattttcaaatattgctaactaatgtagcattaactaacgattggaaactacatttacaacttcaaagctgttttatacatagaaatcaattacagctttaattgaaaactgtaaccattttgataatgcaacaataaagcatcttcagccaaacatctagtcttccatagaccatgcattgcagtgtacccagaactgtttagctaatattctatgtttaattaatgaatactaactctaagaacccctcactgattcactcaatagcatcttaagtgaaaaaccttctattacatgcaaaaaatcattgtttttaagataacaaaagtagggaataaacaagctgaacccacttttactggaccaaatgatctattatatgtgtaaccacttgtatgatttggtatttgcataagaccttccctctacaaactagattcatatcttgattcttgtacaggtgccttttaacatgaacaacaaaatacccacaaacttgtctacttttgcctaaagttacctattagaggtcactgtcagagttctcagtttcttagttactatttaacttttcatgttcaaaatgaaaataattcttaagttgaaagccctcttgaagtaacctttttataaatgagttattataatggtttacttaaataaaaaacaggggtgggtgcngtggctcatgcctccaatcccagcactttggcaaggccaaggcaaaaggatcgctcaagaccaggctacgtcacaaagcgagacctccatctctacaaaagatttaaaaaattagctgagtgtgatggtgtaagcctgtggtcccagctactagggaggctgagatgggaggatcacttgagccctggaggtcaagggtgcagtaaacggtgattgtgccactgcactccatcctgggtgagagcagaccctgtctaaaacaaacaaacgaaaaaacccccacagaatgacagaacataaaagatgcacattttgtcttccaactttttactcttctaaaagcatcttttttaaattttttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagcatctttttctttaatgcagaggttatgttgtattattagcataaatgttttttttctgggaatgcttatttcacacagcacaatactgaatcttctctggaatgtggatcgatttcagatggatgactattaaaatgtgtatatttgcagattatccttaaagggccacctcatgccttctaatttatgtcttacggataaaaaatcaaaatgaagcataaagtaaaaactgtgtccagctttacaagtggacgcttagtaatggctgaggcaatatgtttaatgtagcaaattttacttatttgtcatgatcagttttcacagtgcttgtaagtgctggtaatagaagatggacatggtttaggtcaaaacttggaccagaaaccaacttcctttgaaacagctctaccagttataagagcaatatgctgttaggtgaagaactgtttaacagaaatatattatgtttttgcaaacaggcagctgatccaaaattgtgttgaaacacctcagaaacataaatgacatcaatactctataaattaatgctgttaacaaatttaaaaaataaaacatacaattttcaaattgaaggcacacatcccagttggtactggcaagtttaaattgtttctaatactggtggactcttcatttgtaacctactgagcagttacagagggtactcccattgatacaaaatgctcaggtaccggcatttctccacatccagagttctttctatattcccttctgatttccatcccttatctgttccctgcttttgtccttccccagtctcacccccatctctagccatggtaagtgagatggcggaagcaggtgcctagaagcaagcagcagtaagcagcattttcccactcctcccagagctctgggctcccagactgtgttcctacctctggacaatgctttctcttcctcctgggctcagagggcttcaccagagcctggaccaccagtggtaatagctgcattatttagattttgcttcaggatgctcagaggttaaggttaactgatcatactgaacatcatgaactccaaaagctttcacttaatccttcaggtaaaggaaaattgaggcttgatgactaagttggtagtattaataactacatcagtcaccatatctgtacaacacaaggactcttaaattatacccaaatcatttctatttggctttaggaaaaaaacaagatttccttttcagcatttgttctgttttggccaaataaaaattgttttctttcttcctctaagctcaccctacggcatgtcaggtaacaaaagccagtctgcccagccttccatctttacctttggaaatcgagacctgaatgggtcccattctttttctgtaatccaacagaaaatgaaaaaaaaacaaaaaccaccaaaactttttccccctatttgggattctaagaggacacatgagtcacataagtgcatttaactcagacaactttagatcctaatgaaatactagacaagagagaaaatggcatgagtggacagttctccctcgtcacatactatccctcatggttgcatgaggctgcctgctgatgagattcaagccaacttaaatgaagggcttcaccacatgagaaccttcaatagcaacgtttacatcactggggagtttatgagaccctgagagagggcaagagagtttacaactgaagagaaagttcctatttattctcaaatgccctgactaaactgctcaaaagcagtttatattttcaaaccaatgtcatgtcctcaacataaagttcaaattcatttactgtccatgacacttaagcatccagatcaataaattacaatacacatattctgtaagagtcttttataccaagaagcttgtttttggtcttcggcagtgacatttcctccccattcaccacacaaacgcagcccgctctcgtaacatgcggacaccaaagcgctgccactctcgctgataaatccacagttcctgtgttgtatccaaacaagccaacactgcccctcctttccatgcaatcagccgggggtccatgtccttaggccttgtgatcacatccacattttcaataattcgcctgaaggatggtggcattttgttgagaattctgtgctgcagaaattcttgagctttatgaaacatcaaaccacctcccaccactaggatggagctgtacatcttctttttggtgtcgtcagatgaacagcagtctatgctatggaggatggctttatccaggcccagggctttcccttcaaacagcgagatggcagtcttcctggacatcagtgcagtgagggcctcctcggaatcgttgccggccatcaggccatctccctgtgcagaccccaaatctacctcctgggaatggagtctttctggaagatcagaggactggccacgaagatccccttcaaatccaataggtttggatgcagactttcggtcagcagtagcttttgcagactgttcttgtttgctctgtgtggccagcaggtaatgttcatcgtgaggatcctcaggatcgccctgagatctgtgctgcaaagtcgtcattttctgtccaacaattccaaaagttgcggggtaaaacaaagccattggagcctgcagtttttcatctcctaatcgaaactggtaaagcagggcaggagaatcaggatgtcgaatctgaaactcatggtcctgaagcccagagatgtcctgattccaggaaaagatgctgatctaaatgacaaaaagtttctttaaggtgttgcagaagaagacaatccattttatt

SEQ ID NO: 294 - DNA, 2337 bp, Homo sapiens
  misc_feature: Incyte ID No: 400253.5
  unsure 1924, 2298, 2310: a, t, c, g, or other
ctccgggtgggcgtcggggccgctagctgcggggaagggccgcggcggcggcgactgacagctgggccccggcccctgcctcacaattgaaaaaattaaagctaacatgcttcattaattctggaaatatttactgaaactctgttaaattcaaaattgtatgtttctgtaggctaccattttaaagttctgatgaccaactgtttattagaatactaaaaatgtggccaagcggcccggcgatgtcgctcgtgctgctaagcctggccgcgctgtgcaggagcgccgtaccccgagagccgaccgttcaatgtggctctgaaactgggccatctccagagtggatgctacaacatgatctaatcccgggagacttgagggacctccgagtagaacctgttacaactagtgttgcaacaggggactattcaattttgatgaatgtaagctgggtactccgggcagatgccagcatccgcttgttgaaggccaccaagatttgtgtgacgggcaaaagcaacttccagtcctacagctgtgtgaggtgcaattacacagaggccttccagactcagaccagaccctctggtggtaaatggacattttcctatatcggcttccctgtagagctgaacacagtctatttcattggggcccataatattcctaatgcaaatatgaatgaagatggcccttccatgtctgtgaatttcacctcaccaggctgcctagaccacataatgaaatataaaaaaaagtgtgtcaaggccggaagcctgtgggatccgaacatcactgcttgtaagaagaatgaggagacagtagaagtgaacttcacaaccactcccctgggaaacagatacatggctcttatccaacacagcactatcatcgggttttctcaggtgtttgagccacaccagaagaaacaaacgcgagcttcagtggtgattccagtgactggggatagtgaaggtgctacggtgcaggtaaagttcagtgagctgctctggggagggaagggacatagaagactgttccatcattcattgcttttaaggatgagttctctcttgtcaaatgcacttctgccagcagacaccagttaagtggcgttcatgggggctctttcgctgcagcctccaccgtgctgaggtcaggaggccgacgtggcagttgtggtcccttttgcttgtattaatggctgctgaccttccaaagcactttttattttcattttctgtcacagacactcagggatagcagtaccattttacttccgcaagcctttaactgcaagatgaagctgcaaagggtttgaaatgggaaggtttgagttccaggcagcgtatgaactctggagaggggctgccagtcctctctgggccgcagcggacccagctggaacacaggaagttggagcagtaggtgctccttcacctctcagtatgtctctttcaactctagtttttgaggtggggacacaggaggtccagtgggacacagccactccccaaagagtaaggagcttccatgcttcattccctggcataaaaagtgctcaaacacaccagagggggcaggcaccagccagggtatgatggctactacccttttctgggagaaccatagacttcccttactacagggacttgcatgtcctaaagcactggctgaaggaagccaagaggatcactgctgctccttttttctagaggaaatgtttgtctacgtggtaagatatgacctagcccttttaggtaagcgaactggtatgttagtaacgtgtacaaagtttaggttcagaccccgggagtcttgggcacgtgggtctcgggtcactggttttgactttagggctttgttacagatgtgtgaccaaggggaaaatgtgcatgacaacactagaggtatgggcgacagnataagaagggaagttttggctgaagtaggagtcttggtgagattttgctctgatgcatggtgtgaactttctgagcctcttgtttttcctcagctgactccatattttcctacttgtggcagcgactgcatccgacataaaggaacagttgtgctctgcccacaaacaggcgtccctttccctctggataacaacaaaagcaagccgggaggtggctgcctctcctcctgctgtctctgctggtggccacatgggtgctggtggcagggatctatctaatgtggaggcacgaaaggatcaagaagacttccttttctaccaccacactactgccccccattaaggttcttgtggtttacccatctgaaatatgnttccatcacacnatttgttacttccattgaatttcttca

SEQ ID NO: 295 - DNA, 377 bp, Homo sapiens
  misc_feature: Incyte ID No: 030882CB1
tcagcctccaaaggagccagcgtctccccagttcctgaaatcctgggtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgagagtgaccagaagaaatgacgcagaagtgaaatgaactttttataagcattcttttaataaaggaaaattgcttttgaagtataaaagaaaaaaaaaagg

SEQ ID NO: 296 - protein, 68 aa, Homo sapiens
  misc_feature: Incyte ID No: 030882CD1
MRTSYLLLFTLCLLLSEMASGGNFLTGLGHRSDHYNCVSSGGQCLYSACPIFTKIQGTCYRGKAKCCK

SEQ ID NO: 297 - DNA, 1115 bp, Homo sapiens
  misc_feature: Incyte ID No: 898779CB1
ttagccaggtgtgttggcacattcctgtaatcccagctactcaggaggctgaaacaggagaatcgcttgaacccgggaggtggaggttgcagtgagccgagatcacaccactgcactccagcctgggcgacagagcaagacttcatctcaaaaaaaaaaaaaaagggcggcgctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaaaaaaaaaaa

SEQ ID NO: 298 - protein, 250 aa, Homo sapiens
  misc_feature: Incyte ID No: 898779CD1
MADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPATGPYGAPAGPLIVPYNLPLPGGVVPRMLITILGTVKPNANRIALDFQRGNDVAFHFNPRFNENNRRVIVCNTKLDNNWGREERQSVFPFESGKPFKIQVLVEPDHFKVAVNDAHLLQYNHRVKKLNEISKLGISGDIDLTSASYTMI

SEQ ID NO: 299 - DNA, 529 bp, Homo sapiens
  misc_feature: Incyte ID No: 3727408CB1
tgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctaccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtggcccttccccagaacaggccttagccagcttcgttcgttggatttcaaaggaggatttttagaagcgtccaatgccaggttccaggatgcattaaagtc

SEQ ID NO: 300 - protein, 110 aa, Homo sapiens
  misc_feature: Incyte ID No: 3727408CD1
MPPQLQNGLNLSAKVVQGSLDSLPQAVREFLENNAELCQPDHIHICDGSEEENGRLLGQMEEEGILRRLKKYDNCWLALTDPRDVARIESKTVIVTQEQRDTVALPQNRP

SEQ ID NO: 301 - DNA, 903 bp, Homo sapiens
  misc_feature: Incyte ID No: 984236.1c
cggatggtgaccacagttctctgatccaggtgtatgaagcctttatacaaagtggagcagatgaggcttggtgccaggctcgaggtctgaattgggcagcattgtgccaagcccataaacttcggggagaactcctagaactcatgcaacgaattgaacttcccttgtccctaccagcctttggctctgagcagaatcgcagagaccttcagaaagcactggtgtcaggatactttctcaaggtggccagagacacagacgggactggaaattaccttctcctaacccataagcatgtggcccagctctcctcatactgctgctaccgaagccgcagagctcctgccagacccccaccatgggtgctctaccacaatttcaccatatccaaagacaactgcctttccattgtttctgagattcaaccacagatgctggtggaattggcccctccatacttcctgagtaacttgcctcccagtgagagcagagaccttctgaaccagctaagggaaggaatggcagattctacagcagggagcaaatcatcctcagcccaggagttcagagatccctgtgtcctgcagtgacctgcctgcctatggaatggagctgggttcatctcatcacattagattatccctcagggtgacaccaaagcacccagacagatttagaagcccaaagtttagggtcaaatgtaaaccctggaacctgagtcccaagaaatggtagactgggaatggaaagaatggggtaaaccacagtctacatagggaaggactctttccttagccttctcttattgattggagagggactgacatgctcctcattctcttaactttgccaaacccattcttgtactcccttgtgatctataaaagatttttctatgatgcc

SEQ ID NO: 302 - DNA, 581 bp, Homo sapiens
  misc_feature: Incyte ID No: 984236.2c
  unsure 422: a, t, c, g, or other
cccctggctctgcaatctgtctcctttttagtagtaacaccagggagctcagattctcctcacacaccctgggttgtggcaatggtggagcttctagttctaagaaggacttaggatacaggcagaggcaggatcctgaggggaaaaagacctgggaaagaagaccactgtagatttctcagggcttgcatgttggtgactcttgggttttttatttcagtgagggcaaaggctcttacctggtgggaaccctcttgctcgcaatcgtcttgcctctgcctgacacttgctgattggcctcaacacttggaattctgctcggatcctaggattgtaaacctgttgcccgtcccccaaccaaggccaagacagatcagagtgggccatttctgtctttactaccccaccgctatctctctctntcactcacacttcggagctccagtcctgagtcgatgacatgttggatggaagggagggagaaggagaagtcagccagccagtgagtgaccacaacctttcgggcatccatgtcctcatacacagcctgaacggctcgtccacagtctgggtgaaggggc

SEQ ID NO: 303 - DNA, 881 bp, Homo sapiens
  misc_feature: Incyte ID No: 348082.5
ggcagatgctggtacttgggccaaggctgcaatcagtgattcagccgactgctctttgagtccagatgttgatccagttcttgcttttcaacgagaaggatttggacgtcagagtatgtcagaaaaacgcacaaagcaattttcagatgccagtcaattggatttcgttaaaacacgaaaatcaaaaagcatggatttaggtatagctgacgagactaaactcaatacagtggatgaccagaaagcaggttctcccagcagagatgtgggtccttccctgggtctgaagaagtcaagctcgttggagagtctgcagaccgcagttgccgaggtgactttgaatggggatattcctttccatcgtccacggccgcggataatcagaggcaggggatgcaatgagagcttcagagctgccatcgacaaatcttatgataaacccgcggtagatgatgatgatgaaggcatggagaccttggaagaagacacagaagaaagttcaagatcagggagagagtctgtatccacagccagtgatcagccttcccactctctggagagacaaatgaatggaaaccaagagaaaggtgataagactgatagaaaaaaggataaaactggaaaagaaaagaagaaagatagagataaggagaaggataaaatgaaagccaagaagggaatgctgaagggcttgggagacatgttcaggattcaagccaaaactcgagaatttagggaacgacaagctcgagagcgtgactatgctgaaattcaagattttcatcggacatttggctgtgatgatgagttaatgtatgggggagtttcttcttatgaaggttccatggctctcaacgctagacctcagagcccacgagaag

SEQ ID NO: 304 - DNA, 1380 bp, Homo sapiens
  misc_feature: Incyte ID No: 348082.7
taaaacctgcgacaggaaggatgaggatgggacagaagaggataacagtcgtgttgaacctgttggacatgctgacacgggtttggagcatatacccaacttttctctggatgatatggtaaagctcgtagaagtccccaacgatggagggcctctgggaatccatgtagtgcctttcagtgctcgaggcggcagaaccctggggttattagtaaaacgattggagaaaggtggtaaagctgaacatgaaaatctttttcgtgagaatgattgcattgtcaggattaatgatggcgaccttcgaaatagaagatttgaacaagcacaacatatgtttcgccaagccatgcgtacacccatcatttggttccatgtggttcctgcagcaaataaagagcagtatgaacaactatcccaaagtgagaagaacaattactattcaagccgttttagccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgctccagcctcggcacctcagaatgtatttagtacgactgtaagcagtggttataacaccaaaaaaataggcaagaggcttaatatccagcttaagaaaggtacagaaggtttgggattcagcatcacttccagagatgtaacaataggtggctcagctccaatctatgtgaaaaacattctcccccggggggcggccattcaggatggccgacttaaggcaggagacagacttatagaggtaaatggagtagatttagtgggcaaatcccaagaggaagttgtttcgctgttgagaagcaccaagatggaaggaactgtgagccttctggtctttcgccaggaagacgccttccacccaagggaactgaatgcagagccaagccagatgcagattccaaaagaaacgaaagcagaagatgaggatattgttcttacacctgatggcaccagggaatttctgacatttgaagtcccacttaatgattcaggatctgcaggccttggtgtcagtgtcaaaggtaaccggtcaaaagagaaccacgcagatttgggaatctttgtcaagtccattattaatggaggagcagcatctaaagatggaaggcttcgggtgaatgatcaactgatagcagtaaatggagaatccctgttgggcaagacaaaccaagatgccatggaaaccctaagaaggtctatgtctactgaaggcaataaacgaggaatgatccagcttattgtgtgcaaggagaataagcaagtgcaatgagctgaagt

SEQ ID NO: 305 - DNA, 1091 bp, Homo sapiens
  misc_feature: Incyte ID No: 1097910.1
ccggcgctatgaccacaaccaccaagaactgcttagcctagtcaacctgaatgccttcaaggacctgaatgagaagttctacagcttcatgcagaagatggtcaaggagcactacaaaacctttgagaagggccacatccgggacatcacagacagcctgattgagcactgtcaggagaagcagctggatgagaacgccaatgtccagctgtcagatgagaagatcattaacatcgtcttggacctctttggagctgggtttgacacagtcacaactgctatctcctggagcctcatgtatttggtgatgaaccccagggtacagagaaagatccaagaggagctagacacagtgattggcaggtcacggcggccccggctctctgacagatcccatctgccctatatggaggccttcatcctggagaccttccgacactcttccttcgtccccttcaccatcccccacagcacaacaagagacacaagtttgaaaggcttttacatccccaaggggcgttgtgtctttgtaaaccagtggcagatcaaccatgaccagaagctatgggtcaacccatctgagttcctacctgaacggtttctcacccctgatggtgctatcgacaaggtgttaagtgagaaggtgattatctttggcatgggcaagcggaagtgtatcggtgagaccgttgcccgctgggaggtctttctcttcctggctatcctgctgcaacgggtggaattcagcgtgccactgggcgtgaaggtggacatgacccccatctatgggctaaccatgaagcatgcctgctgtgagcacttccaaatgcagctgcgctcttaggtgcttgagagccctgaggcctagactctgtctacctggtctggttgggcagccagaccagcaggctggcctatgtggtctaaggttcagcctgaaactcatagacactgatctggctgcagttttgctatctgggctgtgggcaagcctaagggatcctgcctgcccctaccctggacttgcctctgcacaccctccagagacaacaggtaaaacagggccacatagatgctgatggagccttccc

SEQ ID NO: 306 - DNA, 3189 bp, Homo sapiens
  misc_feature: Incyte ID No: 246841.1
tttccttctcccacctcccgtcctataatctcccacttaaggtagctgccttcatttcttagagggagctgcagaattattttataaaactaaagaaagaatttcaagggattctaggggtcattaggatcctcacagattatttttggttggggagttgaaactttttaaaggcatataattctagttacctgtgtctgttagctttgtgcatttattttttatttatccttcttttggcttttttttctttgtaccccttcttttcctccttgtttggtaggagcttcaaatattctttttttttctatactaaaggatttgtttccatttgtgtaattggctgtgtacttttcttttctaaaaaaagtttttggttagggatttggtttttggttttgtgtttgttttttctttcctctctcagaaaaaaaaatttcatgctttaaataaaatccaaagacacaccctttcactgctgatgcagaaaaaagggaaagggttcttgttacttgagaatttgtttctgatttaaacaaacaagacttagtttaataaaagaaagagaaaaacaaaagattcccaggttgttatgtgcttcttctgcaagcagagaggcaaatgttaatgacaattccatataccaaaagacacattttttacttcaaagttttgtccttgtgttaggcagtctgagcagcgagtgatccagagcgcagccaacaaagcagcagatagcagtgtacagaaagcaaaaaaggaactgtatgtgaggcacttgtttctgttaatatccatattcctgttaacacacaccctttctcatgtaaaaagaaaaataaaatatggtctgaactttgaaaactttgtgctgctaaaacatagattttggagacaaataaatagatgctttgctgtttcactttcatagctaaacatcaacagaaaccatctccccttgcccccaaagtgtgaaatccttcttcccttcgttttcttccttatgtttcaaaagggaactttgaagactgtgaatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatttatatattttttgccatttaactgttgtatgttactctgtgtctgtaccatatagaaaaaaaattgtttttgtttttggttctctatgtgatatcagttaacaatgtaacactagctttacctgtcaaattctgctaggtcttctctgaaaacgttgtttttaaaaatgatattgcttggtaatagtgcaatttctatccttttccctcccccctcaacttttaagttcttttctttataattttgctgccccctccctgatggtttgggtttttgtttttgtttttggttttttttttcatggagctactatgccatcctccctctgtgaggcagagtgactgtcagtgttttgttatgccatgccttgagctgtgggtgtttggcgacaataaggtggttgaatagattggctgagcacacttccacccacctagtgttctcagaggggttatgtgattgtttcaacctggagtgggttgcacccttaatgctttcctctgcaactaaaccgcccacatatatgttcattgaaaaaagtaagaataattctcagcactaacccagaagtagcaaagcagtcagtgatggtgaacattagaggtcaaacatgagttagatgtttgtgggctgacagccatcgtggctatgaccagtactatttacaaagcatgaattcactacaatgctcaactgtttgtttagctttatctcacttggggaatttattcctgtctgctgcattgtaggtagctgggtaggatatatttccacttgctttttaaattagttcttcacctccattgacactcgttttttggttttctccctatagtgtgggttggtgctagacaccagtctgacccacagaatgggagttatttcatccatctttcctccatccttccaaaaaccacatatctacacaaggaaaaatttaatacatctaggaattttttttttaattacaagctatttaaagagatgaatgtggccaaagttttacacaattgaaaataaagtaaaacagacggcatgtgtttaaacctgagtttatcaggcatggcaggaagttgcaggagagagaggcagtgacccaagccagtgcacttgatgttcatggacatatattttttttaaataataaattaaaacattttaaatagaagcataaattgagttgtttgttggcgctgagatactgcccactgtgaaacaaagctttgactagttttttgtttgtttactttcttcaggggggaggggggcaagtttgggtaggaaagaaagcataaatgaacgtgaccctgaggtgaagaggtatatgaacagcctttgcaatgtacaaaaagaaaaaaaaacaaaaaacaacaaaaaaaatagagcaagtgaaaccaaaaatgatgttcttggtgtttttctataatgtagtcttgttagcttttttgttactgtaacaatgctgatctcgaactgtaccaaaatacatggagactaacaaacagaaccacatggaactttcaaactgaaaaaaaaatttgtcacaaaaactttgttgtcatagttaagttgattgtagatggtaattgaatatactcctttgaaaatatttcatcaagtatgtttcctgctcattgtgatacattaaaaaaaaaatatgagcaaaaacca

SEQ ID NO: 307 - DNA, 757 bp, Homo sapiens
  misc_feature: Incyte ID No: 351241.1
atgactcaaaccccttaaagaacacagaacaaaggcaccactcaccccatttgggggtgttctgttttctttgtggagtttcaagagtcatgggcagattcttcttaggtctaaagttctgctttcctgtattacattacctcacctctttggcttttgtgagtagcagagattaccttgtactgtgagaggattttaccttgatgtgtgtactggcggatgagagctacaaagttaaagctgactgaggacagtttacaggaagcagtcttcactgttttgttttttccacctaggaagttgtttaggatcctaattctaattcagaggtgcattctacagagtcttctccattgcctttcctctcaaaattaatcttgattggcttctctgggcatttgcgtgaggaactgaaactcattttcatagataaatgagagaatgagtttcctcagctccctaaagggcattttgcttctcccagctgaaaggctcccctggattactaggggctaagtgggagtgtctagtgggttgacccccagcaacgtgcagcagccctacagggaatccccaacaaaattagttttaaaaggcttgtccaagaaatgaatataggagctggtcattccatgctttgagccctcctggaggtgctagacctctggagacaaaaatgactcagtggataacacgctatggagtcctgccaataacccagcacacttcaacccatcccactaaaccctaggccttt

SEQ ID NO: 308 - DNA, 1079 bp, Homo sapiens
  misc_feature: Incyte ID No: 2790762CB1
ccggcatgaagacagactcgcttagtcgccagtcacttaagctgagtgcattgtgatttccaataattgaggcagtggttctaaaagctgtctacattaatgaaaagagcaatgtggccagcttgactaagccgccagcgcacagcgcggcaggacgcgcccgggtctcagcggacttgtgcatgttagctgtgtagatttatgtgagggcttgtaaaactctggtcttgtaaactagtcttaagcgcttttaatatggagacagatgagagcccctctccgctcccgtgtgggcccgcaggagaagcggtgatggagagccgagctcgccccttccaagcgctgccccgtgagcagtctccaccacctcccctgcaaacgtccagtggtgcagaggtaatggacgttggctctggtggtgatggacagtccgaactccctgctgaggaccccttcaacttctacggagcttctcttctctccaaaggatccttctctaagggccgcctcctcatagacccgaactgtagtggccacagcccgcgcaccgcccggcacgcacctgcggtccggaagttctcccctgaccttaagttgcttaaggatgtaaagattagcgtgagctttaccgagagctgcaggagtaaggacaggaaggtgctgtacacaggagcagagcgcgacgtgcgggcggagtgcggtctgctccttagccctgtcagtggggacgtgcatgcttgtccctttggcgggagtgttggtgacggggtaggcatagggggtgagagtgctgataagaaggatgaggagaatgagctggatcaggaaaagagagtggagtatgcagtgctcgatgagttagaagattttactgacaatttggagctagatgaagaaggagcaggcgggttcacggctaaagcaatcgttcagagagacagagtggatgaagaggccttgaatttcccctacgaggtatgttggcagcccctcctctagagggctcttagcaaaacccaaagagagatttgggaattgcagcatcttttgaaagcagggaaattaaaaaaaaaaaaaaa

SEQ ID NO: 309 - protein, 247 aa, Homo sapiens
  misc_feature: Incyte ID No: 2790762CD1
METDESPSPLPCGPAGEAVMESRARPFQALPREQSPPPPLQTSSGAEVMDVGSGGDGQSELPAEDPFNFYGASLLSKGSFSKGRLLIDPNCSGHSPRTARHAPAVRKFSPDLKLLKDVKISVSFTESCRSKDRKVLYTGAERDVRAECGLLLSPVSGDVHACPFGGSVGDGVGIGGESADKKDEENELDQEKRVEYAVLDELEDFTDNLELDEEGAGGFTAKAIVQRDRVDEEALNFPYEVCWQPLL

SEQ ID NO: 310 - DNA, 713 bp, Homo sapiens
  misc_feature: Incyte ID No: 2253717CB1
gggcgccgcgggaacgctgtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtggagcccccagaaccatgtgccgagcccgctgcttttggagacacgcttcacatacactacacgggaagcttggtagatggacgtattattgacacctccctgaccagagaccctctggttatagaacttggccaaaagcaggtgattccaggtctggagcagagtcttctcgacatgtgtgtgggagagaagcgaagggcaatcattccttctcacttggcctatggaaaacggggatttccaccatctgtcccagcggatgcagtggtgcagtatgacgtggagctgattgcactaatccgagccaactactggctaaagctggtgaagggcattttgcctctggtagggatggccatggtgccagccctcctgggcctcattgggtatcacctatacagaaaggccaatagacccaaagtctccaaaaagaagctcaaggaagagaaacgaaacaagagcaaaaagaaataataaataataaattttaaaaaaaaaa

SEQ ID NO: 311 - protein, 201 aa, Homo sapiens
  misc_feature: Incyte ID No: 2253717CD1
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 312 - DNA, 1093 bp, Homo sapiens
  misc_feature: Incyte ID No: 2655184CB1
gatggcttgtttttcattttttttgtgctttttggtccatctattaataaaaatgaaccccgttacagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgttttttttaaatttaaatacagaaccactggcaaaaattgaactaagatttacttttttttccatagctgggatataggggggatcctctagagtcgacc

SEQ ID NO: 313 - protein, 88 aa, Homo sapiens
  misc_feature: Incyte ID No: 2655184CD1
MACFSFFLCFLVHLLIKMNPVTESPSCLFSPPSESALASQLALSASCDQRAPFSLAGVVSHDPGWPVVRLHRPLVPEHAVFSQPSLQP

SEQ ID NO: 314 - DNA, 3026 bp, Homo sapiens
  misc_feature: Incyte ID No: 363000.9c
agtgtctttgaaaacaatcaaatataatccttaatgtttctttacattgtcatcaagtattagtaacagtgacttctagtgaacaccttaatccttaaaccacaggtctaagttcagttttgtgattcctttcatttttacactcaaccctgaatatggacaagaccggttagtgtgacctgttattttaggaattacaactttaaaaattcctaatagccacaatctaaatgtgcaattcaaagcttttaacaatttccatgttctaaagtttctaagagtcttgaggttatgctagggctcctggttaaagtaactgccaactgggactgtatgtcacctaagtcaggataactccctggtgaagttacttttatttcaggttctgtattatttctcttagccatattatacccgtaactgtcctttttacagaaacccttccaacttaagagcctgcaaggaagtcatatactgcccaaaaatgcccacataagttgtccatttataaaaagcaatgtaattgacatattgcatggcttccgtaacttcttagctatcttggcttgttcctaacaggaacaggttgtaggctatgtgagaatactaaagacaaaatgcccaatgccagagctctcagtaaataaacaggctgtctgaaaagtgtctttcttgaacatgcttaactttaaggctgaaccttcctgacaccaattctcccaagatttgtgtaaaaggtggaaataaataatttgtttaggaactgtatcttaatgtatccatttagcttgaactcttaatgcaatgacttatctttcatatttaagacagtcaataccgcataatccaaaactatcttaagagcatatttaaggaaactaagccacaagactgttgcattatgatttaatctaattgcacaaaaatttgaaattacaacacctgccattttctaagaggaaggttatgcatgcctccatattcaattctgcactgttacatttgaaccatattgtgaacttttacatcatgatggatcagcttagaattcccatgcaacacctcaaattataaaatggaagcaatttttagacctgtggaaagttttcatgctaaagataaaagccatttgttaatgggcaacttactttgtgtttaagaaccaggttgctgctatactttaaaatgttggtcactaaatattatggaccctgaactggcttctatgcctaaaaaaaaaaaaaatgggttaactatcacttaggtgacatctatatttccttcacttcagaagactaatccatagtgcctctcagctgtttcttataaaataagaatcgtgtaaccaactgcttcccatgggataagaacaatggtaacagtgggttcaactgactatacacaattatgctaatattttattaattcaaaagcactttacaagaaaatataagtatggcttccaataggaatgttatacctggacttggtaccaagctcacagatttgagtttgcaaggaaaaacaggctttcaagttaaagaacaatttgtaaccaaaactttaatcccaaggattctcacaaaacatattacaaatgacagcatgaaaaaaaaatcttgcacagtaactcaaagttcggctctacaatgtacccttaaactggcaggacatttttgaaatcacaaatttgcacataaagaatgtcacgaacagccatgtatccatatacagcaatcaaataaggaacttatgacctaaagcaaaggtaaactttcttgaaacttaacattctataccaactaggcaacctctgcccaggatgagagttggatttttcaaaaacctctaatttaatagtgcagcatttcgttttccctgatggcctgtgtttcacagcagtttttaaagactgcttgttcaactatagctgcagcctatatcccagctatggaaaaaaaagtaaatcttagttcaatttttgccagttgtttctgtatttaaatttaaaaaaaaacacacttccgctgggcaggtttagaggtttattatcagtctgtgcataactaaaagttcaaagcaaattcaattttgcttaagggaacattgtaaagtaacaattcttggtattacatgcctcgtatgatccatttcaaaccatagagaattacacctttgtgtcactgtttcaagagacaaacagatttgaacagctaaaacatcttaaaaatgcaccaagcttatgaagtctcaaacaaaacttgaattttctgtacatactcctgtcaaatgaagtaatttcctgtacaccacttctcttgcaaactgtcttctatttcctttcatttgacctagatcgactacgagacctagagaaggatcgggacggcttgtgatttctctcccgagacagcgatctctctcttctcctatctctagaaagggacctgctccggctgcgagagaagcttctccttcttggagatctgcgacgaggtggaggactcctcctacgataatcatctcgagggcgacgaccccaagagggaggtgggccacgatttctacttcttttttcaccattcgacagttccactcttacacggcagccacatagtgttcttccatctagctctcggactgcatcagctgcatctcggggatcttcaaattcaacaaaagcaaagccgggtgggtttctagcaacccacacacttcggagtggtccatagtagccaaaagcccgttccaattccgtcttgttgccattgtttccaagattgcctacataaaccttacagtccaatggacaggaatcacgatgcatttcgagatctagggttaaaaaatgcggcggctcaaatccacacgctccgatgagtcttcccgctttcctccggcccaacaccaaccaactctctcactcacccggagaaatagaggacactggggtcctggtcgaaggtgaactgtgttccttgaccgtggtgcacatcccaatctacgataaggaccctccggatgcg

SEQ ID NO: 315 - DNA, 1721 bp, Homo sapiens
  misc_feature: Incyte ID No: 232818.15
  unsure 119, 126: a, t, c, g, or other
cagaggagtagagggcagtactgcgcagtagactgcacaggcgcagtcgaggagctccgctcctttcctccttcagccccgccccgccccatttctgccgaatcacagaagttcaagancggtcanctgatgctacgctgtgcggtacacgtgacaacgggggcgaaggcaggcgcaaggagcaagcgcagattgtgggcggctgtgtcagctgacccaaggggccttcgaggtgccttaggccgcttgccttgctctcagcaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaattgaacagtaccgcctgcagagggagaaagaattcaaggccaaggaagctgcggcattgggatcccgtggcagttgcagcactgaagtggagaaggagacccaggagaagatgaccatcctccagacatacttccggcagaacagggatgaagtcttggacaacctcttggcttttgtctgtgacattcggccagaaatccatgaaaactaccgcataaatggatagaagagagaagcacctgtgctgtggagtggcattttagatgccctcacgaatatgaagcttagcacagctctagttacattcttatgatatggcattaaattatttccatatattatataataggtccttccactttttggagagtagcaaatctagcttttttgtacagacttagaaattatctaaagatttcatctttttacctcatatttcttaggaatttaatggttatatgttgtctttttttcctatgtcttttggctcaagcaacatgtatatcagtgttgactttttctttcttagatctagtttaaaaaaaaaaaaaccacataacaattctttgaagaaaggaagggattaaataatttttttccctaacactttcttgaaggtcaggggctttatctatgaaaaagtagtaaatagttctttgtaacctgtgtgaagcagcagccagccttaaagtagtccattcttgctaatggttagaacagtgaatactagtggaattgtttgggctgcttttagtttctcttaatcaaaattactagatgatagaattcaagaacttgttacatgtattacttggtgtatcgataatcatttaaaagtaaagactctgtcatgcatttttccccattcttttttttttccctgtctccgtgacaaccagtggttcttcatttttgatcatgcgaaatgcactttgacccagatggtctgcagaacttcacttaggacattagcacacaaatagcacacatatcacatacccatttatatacataattagaaaatgttcctgatacatgtgtcatgtgatttcttccaacaaatgttttggaaaacagcaagcaactagtctgtaggttgtcttttctctagagatccttgtcctgggacagcctggggcaagttattaagcatatttccttcctggtgggctagatgatgtgcattatacctgtagtaccttcatactagcccttacaagttaaatgtcctgtggccatcttagccgaaagtctttggttgcaaaatcttataggtaaaaacagttgaaagaacattatgggatttccttgcttg

SEQ ID NO: 316 - DNA, 1489 bp, Homo sapiens
  misc_feature: Incyte ID No: 347781.10
  unsure 524-538: a, t, c, g, or other
gaaggtccttcgcaacaggcccatcatgttcagaggtgaggtctgtctgaatgtggaagagaagaagactcgagctgccagggaaggggactgacgagatgatcgccttaggggacctggaggccctctatgtgggctgggtggtggaatgagaggccctcctcatggaggcatggtgcagaaagcaggatttggagtgggaagaaggcttgctccatggcagtgaatcttcatggatcttcacgcggccatacaaaccctagctcctacagaatggtgaatttctttgaccagcctttggtatcttggagtatgaccccagtttgttataaactgcttaagttagtataattttacttcttttgtgtgttaatgatgtgtgctccttctccctctcttccctttcctgacctttagtctttcacttccaattttgtggaatgatattttaggaataacggacttttaaagaagcaaaaaaaaagactgaatttccttgcttactttgcatatacagactggannnnnnnnnnnnnnnacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaagaaaattt

SEQ ID NO: 317 - DNA, 2833 bp, Homo sapiens
  misc_feature: Incyte ID No: 2477616CB1
tgagtggcagttatatagaccggcggcggacacgcgtgtgtgcggacgcagttgcgtgaggggtttgtactatcctcggtgctgtggtgcagagctagttcctctccagctcagccgcgtaggtttggacatatttgactcttttccccccaggttgaattgaccaaagcaatggtgatggagaagcctagtcccctgctggtcgggcgggaatttgtgagacagtattacacactgctgaaccaggccccagacatgctgcatagattttatggaaagaactcttcttatgtccatgggggattggattcaaatggaaagccagcagatgcagtctacggacagaaagaaatccacaggaaagtgatgtcacaaaacttcaccaactgccacaccaagattcgccatgttgatgctcatgccacgctaaatgatggtgtggtagtccaggtgatggggcttctctctaacaacaaccaggctttgaggagattcatgcaaacgtttgtccttgctcctgaggggtctgttgcaaataaattctatgttcacaatgatatcttcagataccaagatgaggtctttggtgggtttgtcactgagcctcaggaggagtctgaagaagaagtagaggaacctgaagaaagacagcaaacacctgaggtggtacctgatgattctggaactttctatgatcaggcagttgtcagtaatgacatggaagaacatttagaggagcctgttgctgaaccagagcctgatcctgaaccagaaccagaacaagaacctgtatctgaaatccaagaggaaaagcctgagccagtattagaagaaactgcccctgaggatgctcagaagagttcttctccagcacctgcagacatagctcagacagtacaggaagacttgaggacattttcttgggcatctgtgaccagtaagaatcttccacccagtggagctgttccagttactgggataccacctcatgttgttaaagtaccagcttcacagccccgtccagagtctaagcctgaatctcagattccaccacaaagacctcagcgggatcaaagagtgcgagaacaacgaataaatattcctccccaaaggggacccagaccaatccgtgaggctggtgagcaaggtgacattgaaccccgaagaatggtgagacaccctgacagtcaccaactcttcattggcaacctgcctcatgaagtggacaaatcagagcttaaagatttctttcaaagttatggaaacgtggtggagttgcgcattaacagtggtgggaaattacccaattttggttttgttgtgtttgatgattctgagcctgttcagaaagtccttagcaacaggcccatcatgttcagaggtgaggtccgtctgaatgtcgaagagaagaagactcgagctgccagggaaggcgaccgacgagataatcgccttcggggacctggaggccctcgaggtgggctgggtggtggaatgagaggccctccccgtggaggcatggtgcagaaaccaggatttggagtgggaagggggcttgcgccacggcagtgaatcttcatggatcttcatgcagccatacaaaccctggttccaacagaatggtgaattttcgacagcctttggtatcttggagtatgaccccagtctgttataaactgcttaagtttgtataattttactttttttgtgtgttaatggtgtgtgctccctctccctctcttccctttcctgacctttagtctttcacttccaattttgtggaatgatattttaggaataacggacttttaaagaagcaaaaaaaaagactgaatttccttgcttactttgcatatacagactggattttttttttttttttacagccatttccccaaaggaatgtcttgcatattactgacatttggtatgtttcattcattggaatatttcttattttctacgtgtttgaaaagcctgtaagaaatacaggatttgataatattttgaaggcaggaaaaacccaaattgtttcttctttgagagtcatgactaccttctggtgtggagaaattgccattggaaaatttgacaattttgattctcactggtatgtttaaaaactgaataaaaggaatagaatttttttttgataaaggatcacaaaacaattctaaaacctaactgtttttaccattgaaatttaaattgtgataataggttttaaatgtctagaatgcaactgataggcttttcttgaactgttagtttttttgaagtagttttttcatgtttaatttgtatttgtaaaaaaacaaaaagcaaaaaaattcccaaaacccagataacaaccagagcaaaactgttgtgccttctatttatctttgatttcagtcttggcaattgtttaaaaaaaaaatctagatttgttttattaggttcagagtatgtggggaattatagaatccctctttcatcactttgtgtatgtcttttgttaacatatttgttatgccttattctaaaattgagtctcaaactggaatgcctttgaagacagatgcttctatagaggttctttgacctaaatagttcagcatttgtatttttattctggtatctaatcagattcctaatcatagcccgtaagaaggaatgttactttaatattggactttgctcatgtgctcgtgtccgcatttttttttttcttaaaatcatagccatatggtaaattttctattttgttatggttctcttttattgatgggcatgcagtgggtgttacttggaaatggccaatttttattaaaatatttctggaaaaaaaaaa

SEQ ID NO: 318 - protein, 466 aa, Homo sapiens
  misc_feature: Incyte ID No: 2477616CD1
MVMEKPSPLLVGREFVRQYYTLLNQAPDMLHRFYGKNSSYVHGGLDSNGKPADAVYGQKEIHRKVMSQNFTNCHTKIRHVDAHATLNDGVVVQVMGLLSNNNQALRRFMQTFVLAPEGSVANKFYVHNDIFRYQDEVFGGFVTEPQEESEEEVEEPEERQQTPEVVPDDSGTFYDQAVVSNDMEEHLEEPVAEPEPDPEPEPEQEPVSEIQEEKPEPVLEETAPEDAQKSSSPAPADIAQTVQEDLRTFSWASVTSKNLPPSGAVPVTGIPPHVVKVPASQPRPESKPESQIPPQRPQRDQRVREQRINIPPQRGPRPIREAGEQGDIEPRRMVRHPDSHQLFIGNLPHEVDKSELKDFFQSYGNVVELRINSGGKLPNFGFVVFDDSEPVQKVLSNRPIMFRGEVRLNVEEKKTRAAREGDRRDNRLRGPGGPRGGLGGGMRGPPRGGMVQKPGFGVGRGLAPRQ

SEQ ID NO: 319 - DNA, 846 bp, Homo sapiens
  misc_feature: Incyte ID No: 360532.1
gggcagaggacatggggactcaggccagcctgagatcactgggaccagaggaggggctggaggatactacacgcaggggtgggctgggctgggctgggctgggccaggaatgcagcggggcagggctatttaagtcaagggccggctggcaaccccagcaagctgtcctgtgagcccgccagcatggatgacatctacaaggctgcggtagagcagctgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctcccaagg

SEQ ID NO: 320 - DNA, 1158 bp, Homo sapiens
  misc_feature: Incyte ID No: 360532.9
ggagaaacaccttgatcttggtttgcaagcccttctccgctaatactgactaccaagctgatccctacaaaaatgcctgtgagcccgccagcattggatgacatctacaaggctgcggtagagcagcttgacagaagagcagaaaaatgagttcaaggcagccttcgacatcttcgtgctgggcgctgaggatggctgcatcagcaccaaggagctgggcaaggtgatgaggatgctgggccagaaccccacccctgaggagctgcaggagatgatcgatgaggtggacgaggacggcagcggcacggtggactttgatgagttcctggtcatgatggttcggtgcatgaaggacgacagcaaagggaaatctgaggaggagctgtctgacctcttccgcatgtttgacaaaaatgctgatggctacatcgacctggatgagctgaagataatgctgcaggctacaggcgagaccatcacggaggacgacatcgaggagctcatgaaggacggagacaagaacaacgacggccgcatcgactatgatgagttcctggagttcatgaagggtgtggagtagatgctgaccttcacccagagctgcctatgcccagcctccaactccagctgagtcctggggttggggagggggtcggggtcccaggacctgagcctggccatgtcctcaaccccaaatcccccgactccctccccagatctgtcctgggggatgcaaataaagcctgctctcccaaaaagaaagagaaggtcccgttagagccgaaatgctggatcccaagagtgtggggggggtgtcaacttgtctgggaattcgatttcccggaaccgagataggcgggatggcccaaaagggattacctgactgtgtatgggtgggagggtcggactttcgaacgagaggtatgctggacccgctccgaattgggggggaggtaatagatttaaaaaaagcccgcgagggccctccgccatgggaaagaacccgggggtggggcatagtaggggggaccaaaaaagaattttgatgtggcccccccccaagtttcacttgggggaaaaggaggctgtggcaaaggccctatcccaatggggaaaagcccgtggggaaaaagaggttttggcgaaaaggccccccgc

SEQ ID NO: 321 - DNA, 498 bp, Homo sapiens
  misc_feature: Incyte ID No: 110245.1
cgcctggttaaatatttttggcaagagtacttcataggccaccctcaaaatttcagcatcactcgtaccaagtatctatcacaaggcagcatgtgtctacatctccaccccagtgctgttacagtgggacagtttctagtgtattgtcattgcgaccaggcttttaagattcttagcatatctgtaatatccacatgcagatgtagaatccaaatcgtatttacagagaactttgcatggcagcttttatatggtagtgatacattcagtttcttacattctagattattcagggaggttctggagttggacagatttggggttaagcctgatggctagctgtgtgaccttacacacctcgcttcatctgtttcctatgggaatttataatagtagctacttcctagggcacaggatctggcccagggaagacctcagtgttagtggactctttaatgatcgttagcagctgttgtgatcataaaacgagaagcacat

SEQ ID NO: 322 - DNA, 1939 bp, Homo sapiens
  misc_feature: Incyte ID No: 478620.53
atgctcagtcctccaggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggagaggtggaggtggaggtggaggtaactatggccaagatcaatcctccatgagtagtggtggtggcagtggtggcggttatggcaatcaagaccagagtggtggaggtggcagcggtggctatggacagcaggaccgtggaggccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagctaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaattttgttcctcttcccccttttcactttcctggaagatcgatgtcccgatcaggaaggtagagagttttcctgttcagattaccgtgcccagcaggaactggaatacagtg

SEQ ID NO: 323 - DNA, 1684 bp, Homo sapiens
  misc_feature: Incyte ID No: 1813444CB1
caggcgtcggtgctcagcggtgttggaacttcgttgcttgcttgcctgtgcgcgcgtgcgcggacatggcctcaaacgattatacccaacaagcaacccaaagctatggggcctaccccacccagcccgggcagggctattcccagcagagcagtcagccctacggacagcagagttacagtggttatagccagtccacggacacttcaggctatggccagagcagctattcttcttatggccagagccagaacacaggctatggaactcagtcaactccccagggatatggctcgactggcggctatggcagtagccagagctcccaatcgtcttacgggcagcagtcctcctatcctggctatggccagcagccagctcccagcagcacctcgggaagttacggtagcagttctcagagcagcagctatgggcagccccagagtgggagctacagccagcagcctagctatggtggacagcagcaaagctatggacagcagcaaagctataatccccctcagggctatggacagcagaaccagtacaacagcagcagtggtggtggaggtggaggtggaggtggaggtaactatggccaagatcaatcctccatgagtagtggtggtggcagtggtggcggttatggcaatcaagaccagagtggtggaggtggcagcggtggctatggacagcaggaccgtggacgccgcggcaggggtggcagtggtggcggcggcggcggcggcggtggtggttacaaccgcagcagtggtggctatgaacccagaggtcgtggaggtggccgtggaggcagaggtggcatgggcggaagtgaccgtggtggcttcaataaatttggtgtgttcaagaaggaagtgtatcttcatacatcaccacacctgaaagcagatgtgcttttccagactgatccaactgcagagatggcagctgagtcattgcctttctccttcgggacactgtccagctgggagctggaagcctggtatgaggacctgcaagaggtcctgtcttcagatgaaaatgggggtacctatgtttcacctcctggaaatgaagaggaagaatcaaaaatcttcaccactcttgaccctgcttctctggcttggctgactgaggaggagccagaaccagcagaggtcacaagcacctcccagagccctcactctccagattccagtcagagctccctggctcaggaggaagaggaggaagaccaagggagaaccaggaaacggaaacagagtggtcattccccagcccgggctggaaagcagcgcatgaaggagaaagaacaggagaatgaaaggaaagtggcacagctagctgaagagaatgaacggctcaagcaggaaatcgagcgcctgaccagggaagtagaggcgactcgccgagctctgattgaccgaatggtgaatctgcaccaagcatgaacaattgggagcatcagtcccccacttgggccacactacccacctttcccagaagtggctactgactaccctctcactagtgccaatgatgtgaccctcaatcccacatacgcagggggaaggcttggagtagacaaaaggaaaggtctcagcttgtatatagagattgtacatttatttattactgtccctatctattaaagtgactttctatgaaaaaaaaaaaaaaa

SEQ ID NO: 324 - protein, 462 aa, Homo sapiens
  misc_feature: Incyte ID No: 1813444CD1
MASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGRRGRGGSGGGGGGGGGGYNRSSGGYEPRGRGGGRGGRGGMGGSDRGGFNKFGVFKKEVYLHTSPHLKADVLFQTDPTAEMAAESLPFSFGTLSSWELEAWYEDLQEVLSSDENGGTYVSPPGNEEEESKIFTTLDPASLAWLTEEEPEPAEVTSTSQSPHSPDSSQSSLAQEEEEEDQGRTRKRKQSGHSPARAGKQRMKEKEQENERKVAQLAEENERLKQEIERLTREVEATRRALIDRMVNLHQA

SEQ ID NO: 325 - DNA, 2825 bp, Homo sapiens
  misc_feature: Incyte ID No: 474588.21
  unsure 1733, 2736, 2816: a, t, c, g, or other
aataattagcttgctttcgaatatctggacttagacagtcttagcctttggcctctcaagggctctaaatctctatgcacaattttgtgttttcattttggtgtggaaaatctttgtaaattttatcctattgtcagagtagtcatagaaccataaaaggataaagaagcctgatctagatctttgctgctgcttcagagaatcttttcagagagaaataaatgagttgaatatttttcaagactaacattttctgaaactttaagaagaaaaaattttctaacattgtgaacagattaagtagctattttattaaatgctttgattttaattgaggtagtttttttgaaaacacgggaattttagtttggaattaggcaaagattgtttaacagttggtgagtttaagttaagtgaccttcagattttagcaatttcatgatttacaaatcgtgggttatatttttttctcttaaatatatttctgtgtcatatttttagtctgtagattttcttatggtcccatgattattggtgtatactttttttttcttggtaagacctttaagttttatgattttcaattgagataatgtataatgtttgagttttaggctatataaggaattagctttcctgcatttaaaggaatcatttggcagtcagtagcatattttcctgattttttgttgttgttaaaggagataagttgataactgtatgttgaagggttctcatgatattctctaaaaagtgcaaatatcagtgcttgatttatagatgtgtaataaacagtggtctgtaaaagcatgtagtataaaaaatatggtattttcccttatatacagcctataaactcttcctattccttgagtttagggtagactaacaaattacagcgtagaagagagtcagctaccagattaaatgcatgcgtaccatacagataatttattaagtatttttgcatattgaacattgacttacattaattttcccttttcaccaccacgtctttgtcattttgaccctgaacacttaataaatcactcagattgatctaaaatatgcttatgtatactttaatagaaaattacattgcatggctttctgacttgggtttttgttataaaagtgcctgttttgttcatgtgtcctgagagagcaagcattgtgacatacctgactaacttaaaagcagattgcctgtgaagcacaatttgagtccaattttttgaggtatggagttttagctatcatggctgggtttttactcaatctcaaataatagggctctggttattttgcagagtgtctctgaagaatggacagaattgccctggctaactacaagctacggttcacagtggataaatgttggcgtgcttttttactttctgactttttaaaattttgcttttatatcttgtagttccaatcaattttatatgaatgctattataaaattcagtgtaaaatcttttcttgtctagcttaaaacttgtgtgtgtctagtatttttcttcaatgatttaacatttctgaaaatgtcaagttctcaaaatttagacaaaaaggggggtataaattgatctgaaaaaattaaatagtttaattagtttagggaatatacaactttttcattcttttggtttccagttttctatttttttttaatgattaggtagaatatagtgtcaaataagttataaattgcatggttaaagaaagcnattcatctaatgtcctgtgaactttataagtggttaagtagttcatgtgagtagctgctttcaccatgcttaatatttaaaagtttaaaaagttttttgaagagagaggcaatttctgtacaatataaatatacatatatacttaagttattgatttgcatgtctataaaattaagcctcatttcctaatacatgataaattttgtagaataaaaggtgaatttgcattaaaggttcactttaatgaaggtgaaacatgagaatgagttgtgtgtgaaattcttatttgatatccagaggatagtttgcaaacctaaacttctgattgtttctgatttcagagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtgtaggtgtattggagaagaaaaggaaatgtggaattttggagaaaaatacgctagattttaaatgttagagctgttcccggagacttattgcagaaatagatgagaagcaaatcaagactactattcaaaaatcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggcccagtngggccagtggtatggaaatgcacaacaaattggccagtatatgcctaatggttggcaagttcctgcatatggaatgtatngccaggcat

SEQ ID NO: 326 - DNA, 997 bp, Homo sapiens
  misc_feature: Incyte ID No: 407838.1
  unsure 740, 746, 819: a, t, c, g, or other
atttaatatctcattcaaacacaataaataaataagaagggaacaaatgcaattacataaaaatcacactgtcattataactaaaaaaaatctaaattttaaattatctatgggtaaaaaaaaaatcaagcaaacagaaatattcaagaacaccaacaaactccagcaagctacctccatggaacaggggagagggcaactagcaatgcctaaaattaatgctgaaccatcagccaagaatggaagattattcaacttgtgaaaataaagattgcaggggtcaaattgataaagtataagggcgtgttggatgaaaaggtagtctcctaggagtggaggaacacagtgaaaggagttgatggaaatggaaaagcattctttcgaagcacaaggatgaattgcaaaagagcaagtggaaaaaaacaagattttcaaggcaaaagaaaatttaaaaaattaaaagcgtacaacctggtccccacttcctcactcctcctaagaaaaatctaatacagaattatatgctttgttacagagacagaagtgagtgatttttaaaccaagatccttataaaaccacagattgtcagtcttgtcaataaaaattcagaatatcaaacactcttttctgaaaatgttgacaaagttaaatgaaaaatataaagttatacaatttagctggcaaaaaagcccttccctcacccccccaaaaaccatggcacttggtcaagcagaagaanactganatatagcagtataaattgaattgcaaatcttaaaccagtgtttatggatctgaaaaatcatcttgaatcaganataaaaaatctaaaatataatgttaataacaggaagaaataaaatttattgagtcaagaaaataaatagaagggatgttaaaatcatattagaaataattatgaagttacaaagtgacctagagagaataaatttgaatgagaaaccttaaactaaggctagatatagatagacaggc

SEQ ID NO: 327 - DNA, 509 bp, Homo sapiens
  misc_feature: Incyte ID No: 994387.19
agctcttggacttctgaggctgtttcctaatttcaaaattaaaagcatattggcagaggaagagccctggcattccagcaggagctaacaggaaaaagaaaatcaatggcagtagccctgacacagccacttctggtggttaccactcacctggggattcagcaacaggtatctacggggagggccgtgcatcctctactaccctggaggatctggagagccagtaccaagaactagcagtggccctggattcaagctccgcaataatcagtcaactcactgaaaacatcaattcactggttcgcacatctaaggaggagaagaagcatgagatacatctggtacagaagcttgggaggagcttgttcaaactcaaaaaccagacggaacaacgagaacaagagcacactgcagttggagcagcaagtaaaggagctgaagaagtcaggtggagctgaagagccaagaggctccgagtctgcagcagcagccagaccagtagctggagc

SEQ ID NO: 328 - DNA, 4227 bp, Homo sapiens
  misc_feature: Incyte ID No: 347796.7
ccgtggcttcagccttggcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcggggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccccgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttctggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtctcgatttgcttcaggcggcatttgtaaactgtcaccctgcttgcaaaccctcatttaaatgggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtc

SEQ ID NO: 329 - DNA, 525 bp, Homo sapiens
  misc_feature: Incyte ID No: 406498.4c
gccagtgtaacgctctgggttcagcaataggtctacatactgagcagctggagatctctcatcatcaagttcacaaaagtgatcccgtgaatcatcatatcttgcccagtcaatgaaagcttctttgctttgattacttaatgtgctgttaattgctcccagtttattagcttgctcacaatcttctaattctttggtattgtttgccattttcaagtacttattagaatgcccagcttttattccaaccggaattttactctctggacagggctccacatgacagtcttttattgaacagtggccatcttctgcccagaaaggacaaggtcgcttcagattaaccttgtaataacgaaaatagtctctctcttgcaatttttttattttggggaagattttgtaggtattgaagttatcgatgctgtcaatatcacacaagcaatcatccagaactccagtgacctgcgcctcgacgacgctccgcaggaagctcagggtgaccagcagctgcaccgcggccgc

SEQ ID NO: 330 - DNA, 1744 bp, Homo sapiens
  misc_feature: Incyte ID No: 3346307CB1
ccaagggggaggtgcgagcgtggacctgggacgggtctgggcggctctcggtggttggcacgggttcgcacacccattcaagcggcaggacgcacttgtcttagcagttctcgctgaccgcgctagctgcggcttctacgctccggcactctgagttcatcagcaaacgccctggcgtctgtcctcaccatgcctagcctttgggaccgcttctcgtcgtcgtccacctcctcttcgccctcgtccttgccccgaactcccaccccagatcggccgccgcgctcagcctgggggtcggcgacccgggaggaggggtttgaccgctccacgagcctggagagctcggactgcgagtccctggacagcagcaacagtggcttcgggccggaggaagacacggcttacctggatggggtgtcgttgcccgacttcgagctgctcagtgaccctgaggatgaacacttgtgtgccaacctgatgcagctgctgcaggagagcctggcccaggcgcggctgggctctcgacgccctgcgcgcctgctgatgcctagccagttggtaagccaggtgggcaaagaactactgcgcctggcctacagcgagccgtgcggcctgcggggggcgctgctggacgtctgcgtggagcagggcaagagctgccacagcgtgggccagctggcactcgaccccagcctggtgcccaccttccagctgaccctcgtgctgcgcctggactcacgactctggcccaagatccaggggctgtttagctccgccaactctcccttcctccctggcttcagccagtccctgacgctgagcactggcttccgagtcatcaagaagaagctgtacagctcggaacagctgctcattgaggagtgttgaacttcaacctgagggggccgacagtgccctccaagacagagacgactgaacttttggggtggagactagaggcaggagctgagggactgattccagtggttggaaaactgaggcagccacctaaggtggaggtgggggaatagtgtttcccaggaagctcattgagttgtgtgcgggtggctgtgcattggggacacatacccctcagtactgtagcatgaaacaaaggcttaggggccaacaaggcttccagctggatgtgtgtgtagcatgtaccttattatttttgttactgacagttaacagtggtgtgacatccagagagcagctgggctgctcccgccccagcccggcccagggtgaaggaagaggcacgtgctcctcagagcagccggagggaggggggaggtcggaggtcgtggaggtggtttgtgtatcttactggtctgaagggaccaagtgtgtttgttgtttgttttgtatcttgtttttctgatcggagcatcactactgacctgttgtaggcagctatcttacagacgcatgaatgtaagagtaggaaggggtgggtgtcagggatcacttgggatctttgacacttgaaaaattacacctggcagctgcgtttaagccttcccccatcgtgtactgcagagttgagctggcaggggaggggctgagagggtgggggctggaacccctccccgggaggagtgccatctgggtcttccatctagaactgtttacatgaagataagatactcactgttcatgaatacacttgatgttcaagtattaagacctatgcaatattttttacttttctaataaacatgtttgttaaaacaaaaaaaaa

SEQ ID NO: 331 - protein, 232 aa, Homo sapiens
  misc_feature: Incyte ID No: 3346307CD1
MPSLWDRFSSSSTSSSPSSLPRTPTPDRPPRSAWGSATREEGFDRSTSLESSDCESLDSSNSGFGPEEDTAYLDGVSLPDFELLSDPEDEHLCANLMQLLQESLAQARLGSRRPARLLMPSQLVSQVGKELLRLAYSEPCGLRGALLDVCVEQGKSCHSVGQLALDPSLVPTFQLTLVLRLDSRLWPKIQGLFSSANSPFLPGFSQSLTLSTGFRVIKKKLYSSEQLLIEEC

SEQ ID NO: 332 - DNA, 947 bp, Homo sapiens
  misc_feature: Incyte ID No: 4005778CB1
ctagttctagatcgcgggcggccgctcgcgatctagaactagtcctcgagccgaattcggctcgagcggctcgaggcggtcccgcgggtctgtctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaattggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttggaccaaatggaaataaagctttttgatgcaaaaaaaaaa

SEQ ID NO: 333 - protein, 175 aa, Homo sapiens
  misc_feature: Incyte ID No: 4005778CD1
MSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 334 - DNA, 4252 bp, Homo sapiens
  misc_feature: Incyte ID No: 995575.17
  unsure 1730, 1747, 1751, 1763, 1769, 1771-1772, 1778: a, t, c, g, or other
ccgccttccccacaactgatggggttgaaatttcctttccggctcagcagggagaaaagatatggtggggtgcttaacagaggagcgccatctgctcgcggcgccgcctgcctggctcctgcccgctggctgctgccgctgccgccctgagtcactgcctgcgcagctccggccgcctggctccccatactagtcgccgatatttggagttcttacaacatggcagacattgacaacaaagaacagtctgaacttgatcaagatttggatgatgttgaagaagtagaagaagaggaaactggtgaagaaacaaaactcaaagcacgtcagctaactgttcagatgatgcaaaatcctcagattcttgcagcccttcaagaaagacttgatggtctggtagaaacaccaacaggatacattgaaagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataagcgatttgaaattattaatgcaatttatgaacctacggaagaagaatgtgaatggaaaccagatgaagaagatgagatttcggaggaattgaaagaaaaggccaagattgaagatgagaaaaaggatgaagaaaaagaagaccccaaaggaattcctgaattttggttaactgtttttaagaatgttgacttgctcagtgatatggttcaggaacacgatgaacctattctgaagcacttgaaagatattaaagtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtacagggtgccagatagattggaaaaaaggaaagaatgtcactttgaaaactattaagaagaagcagaaacacaagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaagatgatgatgatgattatgatgaagaaggtgaagaagcggatgaggaaggggaagaagaaggagatgaggaaaatgatccagactatgacccaaagaaggatcaaaacccagcagagtgcaagcagcagtgaagcaggatgtatgtggccttgaggataacctgcactggtctaccttctgcttccctggaaaggatgaatttacatcatttgacaagcctattttcaagttatttgttgtttgtttgcttgtttttgtttttgcagctaaaataaaaatttcaaatacaattttagttcttacaagataatgtcttaattttgtaccaattcaggtagaagtagaggcctaccttgaattaagggttatactcagtttttaacacattgttgaagaaaaggtaccagctttggaacgagatgctatactaataagcaagtgtaaaaaaaaaaaaaaaagaggaagnaaatcttaagtgattgntgcngttttcttttanaaaaanannaatagnattcattttctttgggttagagctagagagaaggccccaagcttctatggtttcttctaattcttattgcttaaagtatgagtatgtcacttacccgtgcttctgtttactgtgtaattaaaatgggtagtactgtttacctaactacctcatggatgtgttaaggcatattgagttaaatctcatataatgtttctcaatcttgttaaaagctcaaaattttgggcctatttgtaatgccagtgtgacactaagcattttgttcacaccacgctttgataactaaactggaaaacaaaggtgttaagtacctctgttctggatctggggcagtcagcactctttttagatctttgtgtggctcctatttttatagaagtggagggatgcactatttcacaaggtccaagatttgttttcagatatttttgatgactgtattgtaaatactacagggatagcactatagtattgtagtcatgagacttaaagtggaaataagactatttttgacaaaagatgccattaaatttcagactgtagagccacatttacaatacctcaggctaattactgttaattttggggttgaacttttttttgacagtgagggtggattattggattgtcattagaggaaggtctagatttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgggttattattctgagttatctacaaacatttttgagatttgtctttacactctgattgtagtttccagcagcccacgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatttctgttttagcacacttaatcaggaaaggatatattaactttcataaaaatatttttgttgtgtgaataggttaatgatatggtaaggcccctaaaataactgaattaattgtttattgtaattgtaggccattcccattattaaaaataaagacaaaacttgaagtaactgaaaatcttatcgtgctatgtagaaatattgaactaatattcaaatatttgaatgctttggtttcagggattggtttaaaattggagtccttttttatgggttagtcttacaaaaatttaagcctttatatttttgactttaaatcaaaacaaatgttattttaaatgtacagaatagattggtagtgcagaagagtgtaagttcttcataggagctttagaaaagagaaatatgtgctaattcagtttttttttaatctgcactgtacatatatacttggtaattatgagcttgattttgtttttggaaatatgtgttcataatttaggtaatttgctacttaaagcactaagtctctgatacctgaaaagtacatgtaaatggtgatggtgaaataatactgcagttaacttaatagatgtatactggtgatttttgtatgctggattaaaactccagatattaaaatataacctggat

SEQ ID NO: 335 - DNA, 4303 bp, Homo sapiens
  misc_feature: Incyte ID No: 863406CB1
taacactgacaatcggtatgattgatccggattttgcagataagcctaaattaccagaaaactacacagatgaaacctggcaaaaactgaaagaagcagtggaagctattcagaatagtacttcaattaagtacaatttagaagaactctaccaggctgtagaaaatctctgttcttacaagatttctgcaaacttgtacaaacagctgagacagatctgcgaagatcacatcaaagcacagattcatcaattcagagaggattcattggatagcgttctttttttaaagaagattgatagatgctggcaaaaccattgcagacaaatgatcatgatcaggagcatttttttgtttctggatagaacttacgttcttcagaattcaatgctaccctccatttgggacatgggactggagttatttagggctcatattataagtgatcagaaagtgcagaataagacaattgatggcattcttctcttgattgagagggaaaggaatggtgaagcaattgatagaagtttacttcgaagccttttaagcatgctgtctgatttgcaaatttatcaagattcttttgaacaacgatttttggaagaaactaaccggctctatgcagctgaaggccaaaaattaatgcaagaaagagaggttcctgaatatctacatcatgttaacaaacgtctagaagaagaagcagacagacttattacttacttagatcagaccacccagaagtcattaattgctactgtagaaaaacaacttctaggtgaacacttaacagcaattcttcagaaaggtttaaataacctccttgatgaaaaccgaattcaagatttgtctcttctgtatcagctcttcagtagagttcgaggtggagttcaggttcttttgcagcagtggatcgaatatatcaaggcatttggcagcactattgtaattaatcctgaaaaagataaaaccatggttcaagaattgctggattttaaagataaggttgaccatataattgatatctgctttctgaagaatgagaaatttatcaatgccatgaaagaagcatttgaaacgttcattaacaaaagaccaaataaaccagctgaacttatagctaagtatgtagattcaaaacttcgtgcaggcaacaaagaagctacagatgaagaacttgagaaaatgttggataaaattatgatcatatttagatttatctatggcaaggatgtttttgaggccttctataagaaagatttagccaagcgcctgttagtcggaaagagtgcatctgtagatgctgaaaaatcaatgctgtccaaacttaaacatgaatgcggagctgctttcaccagcaaacttgaaggaatgtttaaagacatggaactttctaaagacatcatgattcagttcaaacagtatatgcagaatcagaatgttccgggaaatattgagttaactgtgaatatcctgacaatgggctattggccgacatatgtgcctatggaagttcatttaccaccagagatggtaaaacttcaggagattttcaagacattttacctaggcaaacatagtggcaggaaacttcagtggcagtcaaccctaggacactgtgtgttaaaagcagaatttaaagagggtaaaaaggaactccaggtctctctttttcaaacactggtgctgctaatgtttaatgagggagaggagttcagtttagaagagatcaagcaggcaactggaatagaggatggagagttaaggagaacactgcagtcattagcctgtggcaaagctagagttctggcgaaaaatccaaagggcaaagacattgaagatggtgacaagttcatttgtaatgatgatttcaaacataaacttttcaggataaagatcaatcaaatccagatgaaagaaacggttgaagaacaagcaagcactacagaaagagtatttcaagacagacagtatcaaattgatgctgcaattgttcgaattatgaagatgagaaagacacttagccacaatctccttgtttcagaagtgtacaaccagttgaaatttccagtaaagcctgctgatcttaagaagagaatagaatctttaattgaccgggactacatggaaagagataaagaaaatccaaaccagtacaactatattgcatagaatgttggccttgcagcatttggtgtcatatgcagtagccagtggataaactaacctgttgattcaatattatttgactccttttttactaccgatgaccaaatgaagcagtgtaattaatggaaatagttgagtggactttttctcagtggttaacatgcccattttaaagagtaatacttacctttaagaagaatgttgttgaactctttgcatgttatttagtatgatgtgcagaaaacacttaagaacgtacctggtcttcatgaattcctctttggaactgggaaagagatccctgtggctattaaaaaggggggagggttcttacacaccattaattatgaagcaaaaggtttatttgcttaaaatgtcatttaaagatacttaaactgcatgcaaactttatttactgtacagagttctggatgtatttatcaaatagaaaaaccacccttgacttggttgttcacccgttttgtgatttcccttgaaaagagaaatgaattgtcatagctattgatattttactaggtgatgttctgttacactgaaagggatgttttttaaaaaaaattatttggaaacaagttttcaagtagggggacagttgcttacataatatcttgtatattcacatcctaaaaattttcatttatgagtatgggatgtgtgtatatggcttagccccaagttaactgtgctgattaacaagtacttataaaaatagctaaagtagaaaattaatgatcagttgtactagaggaacatcatagaagagaaaaatccaactctttatattaaaaatgaatacaataagaaaattgcaaaagagaccaaaatgaacgtgttttgtaaattgttacaggagcaaaaactttgcaactagttttcaacatactttagactttaaatgttgtttggacagttttgtcttcaacttggaccaattgtagattgttacaggcttcctaggatttagcattcctattttctctaccaaagttttttttagaagcatcccaactcttctctttgttgataaataagcctttcctgtcatcttcattttaacttgctaaaaccctagatacaaaggtcctccctcatttttcccacagagcccctgtttgggaatttgagattctgtgtcatgctggttttcctttcagaattgcttgaaatcgagttctcttagccactggacacctagttttcaggagaatgtcccaagattgtttatatatacaaaatggcaaaagtactgtttttcgaattgataattcaagcaaaggcttctctttactgtcactgatttttttttgtttttattttgtttccttgtttctatttccttgaagctttgaagggaggagaagcagaaaattttgtttatgtttgttaaaaatcagaactacttaatgctttttgccacagcatatttccttgcctgttggagccgttaggaagattacctatgtcctaatcttcaacctgagaagatttttgactcttgtgtctactgttgattgtttgcttgagttctcaaagacctgtggccaggtattttaaaaagtcgtctatttctttctagttgcatcaacttgcacactggtgtctaactatatgtggtattcggaacttgtaattcttattgagcagccattgcctatattttctcagctcctcactgatttctttatatgagctcagctgacaagcaaatgcagctattttgtttaccctctcttcataccggaccatcaacaacagtgttctaactcatccctgatggtctgtgagatgtagactattacacaagattcaagttactcgtaagcaacttttagatagagttggtcctgttaggaggagactcttgatgtcaccttcagtatcttgaaagcgggtcccctccccgaggctcttaattctttgaaaacttgatgctgtttcagctgaaaaattagcaagactgttaaaaaaaaaaagttgaggggagctgtttaagaaactgaaaagtaattgcaaactacattggataattgtgactttcagttgttgttctgtatcagttgaatttttgtgctcttttccctgtgtacgtggtggttctattttctccaatagaa

SEQ ID NO: 336 - protein, 717 aa, Homo sapiens
  misc_feature: Incyte ID No: 863406CD1
MIDPDFADKPKLPENYTDETWQKLKEAVEAIQNSTSIKYNLEELYQAVENLCSYKISANLYKQLRQICEDHIKAQIHQFREDSLDSVLFLKKIDRCWQNHCRQMIMIRSIFLFLDRTYVLQNSMLPSIWDMGLELFRAHIISDQKVQNKTIDGILLLIERERNGEAIDRSLLRSLLSMLSDLQIYQDSFEQRFLEETNRLYAAEGQKLMQEREVPEYLHHVNKRLEEEADRLITYLDQTTQKSLIATVEKQLLGEHLTAILQKGLNNLLDENRIQDLSLLYQLFSRVRGGVQVLLQQWIEYIKAFGSTIVINPEKDKTMVQELLDFKDKVDHIIDICFLKNEKFINAMKEAFETFINKRPNKPAELIAKYVDSKLRAGNKEATDEELEKMLDKIMIIFRFIYGKDVFEAFYKKDLAKRLLVGKSASVDAEKSMLSKLKHECGAAFTSKLEGMFKDMELSKDIMIQFKQYMQNQNVPGNIELTVNILTMGYWPTYVPMEVHLPPEMVKLQEIFKTFYLGKHSGRKLQWQSTLGHCVLKAEFKEGKKELQVSLFQTLVLLMFNEGEEFSLEEIKQATGIEDGELRRTLQSLACGKARVLAKNPKGKDIEDGDKFICNDDFKHKLFRIKINQIQMKETVEEQASTTERVFQDRQYQIDAAIVRIMKMRKTLSHNLLVSEVYNQLKFPVKPADLKKRIESLIDRDYMERDKENPNQYNYIA

SEQ ID NO: 337 - DNA, 1646 bp, Homo sapiens
  misc_feature: Incyte ID No: 413864.17
attatgtcatgtctggtagtttatactttaagtaatatgctatctgaacccggctatgtacattgaggcatattttaatacactcagactacaaattacaacaacatgcaataaataggacaccaacaaaaagtcagcacaaagtgaactttactgagtattataatcagctctttggaatgccagtttttcatagtgatattaagatatggttgttaaattagatcacaaaaattgcttttcttttaaatagaaaatgttatcaatcacacggatgaagaaggatttactcctctgatgtgggctgcagcacacgggcaaatagctgtggtagagttcctacttcagaatgtaaggaaaatgcctcagaaaatgtatatgtatagttacttaagttaagtctttagtagagtttttatatatccagccagctagatataatggtagaggctaccaaaaaaagtttaatgcttttcatattcttgtggaacttggatctagttgggaaggcaagactaatcatacatgcaacagtgagaaataatttaacgcccagacccctctacatcccacgggaacagaagtactgtcagctttgaaggagaaggcttcatggaggagctgtgacttgactccagagtgaaaggataattaggattgatacaggacggaggaaggaaggcatccaggcaatctcaataaaagcatccatgagtaaaagtttccattatttctttattaagcccagaacattaccaggcctagtgttgaactataattattgttgacaggaataacaatattcttgtttaaactaattgagaagtcttttatctctacttcccataccagggtgctgatccccaacttttaggaaaaggtcgagaaagtgcactgtcgttggcctgtagtaaaggctacacagatattgtcaaaatgctgcttgattgtggagttgatgtaaatgaatatgattggaatggaggaacacctctgctttatgctgtacatggaaatcatgtgaaatgtgtaaagatgctcttagaaagtggggctgatccaacaattgaaactgactctggatataattctatggatctagctgtagccctaggctatagaagtgttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggtttttagtaggttttaataaatatttctctgagtaattcactggtttataataaatgtaatactctttttataactatgttttactgtatatttaaaattataaattaatgttttcgtggcatgtaaatttttatggtacagatagttatcatcagtctttgtatcaagtgctgtaatttgacattttcagaaattattctaccctagtcatcttcactcgtgtattaagtcattcactttatatagggtttgctataaatccctagaaaaaaattgttcttattgttgaattaaaaagtgcacagtgtgattgtttacaaaatgatattataaaataaataaaatacttcctctggtcc

SEQ ID NO: 338 - DNA, 3203 bp, Homo sapiens
  misc_feature: Incyte ID No: 350106.16
gcgctgccgcagcgaggcccggggaggccgcggcggaggcggaggcccggcgccctgggcggcgccctgtccccgaagtccgtcctccccgttaggtggcgagcgcccgaggggaggggacagccgggcaagcaggaagctgcggcttaaaagggcaacccgcgcgggacccttcctccctagtcgcggggagtctgagaaagcgcgcctgtttcgcgaccatcacgcacctcccctccgcttgtggccatgtaccgctacctgggcgaagcgctgttgctgtcccgggccgggcccgctgccctgggctcggcgtccgccgactcggccgcgttgctgggctgggcccggggacagcccgccgccgccccgcagccggggctggcattggccgcccggcgccactacagcgaggcggtggccgaccgcgaggacgaccccaacttcttcaagatggtggagggcttcttcgatcgcggcgccagcatcgtggaggacaagctggtggaggacctgaggacccgggagagcgaggagcagaagcggaaccgggtgcgcggcatcctgcggatcatcaagccctgcaaccatgtgctgagtctctccttccccatccggcgcgacgacggctcctgggaggtcatcgaaggctaccgggcccagcacagccagcaccgcacgccctgcaagggaggtatccgttacagcactgatgtgagtgtagatgaagtaaaagctttggcttctctgatgacatacaagtgtgcagtggttgatgtgccgtttgggggtgctaaagctggtgttaagatcaatcccaagaactatactgataatgaattggaaaagatcacaaggaggttcaccatggagctagcaaaaaagggctttattggtcctggcattgatgtgcctgctccagacatgagcacaggtgagcgggagatgtcctggatcgctgatacctatgccagcaccatagggcactatgatattaatgcacacgcctgtgttactggtaaacccatcagccaagggggaatccatggacgcatctctgctactggccgtggtgtcttccatgggattgaaaatttcatcaatgaagcttcttacatgagcattttaggaatgacaccagggtttggagataaaacatttgttgttcagggatttggtaatgtgggcctacactctatgagatatttacatcgttttggtgctaaatgtattgctgttggtgagtctgatgggagtatatggaatccagatggtattgacccaaaggaactggaagacttcaaattgcagcaacatgggtccattctgggcttccccaaggcaaagccctatgaaggaagcatcttggaggccgactgtgacatactgatcccagctgccagtgagaagcagttgaccaaatccaacgcacccagagtcaaagccaagatcattgctgaaggtgccaatgggccaacaactccagaagctgacaagatcttcctggagagaaacattatggttattccagatctctacttgaatgctggaggagtgacagtatcttactttgagtggctgaagaatctaaatcatgtcagctatggccgtttgaccttcaaatatgaaagggattctaactaccacttgctcatgtctgttcaagagagtttagaaagaaaatttggaaagcatggtggaactattcccattgtacccacggcagagttccaagacaggatatcgggtgcatctgagaaagacatcgtgcactctggcttggcatacacaatggagcgttctgccaggcaaattatgcgcacagccatgaagtataacctgggattggacctgagaacagctgcctatgttaatgccattgagaaagtcttcaaagtgtacaatgaagctggtgtgaccttcacatagatggatcatggctgacttcctcactatcctcttcacatgtaacttctgcagacctatcacaagtttacatgtaaccacagaaatccctttctctcctgactcattaataatggataccattctcaacaagtcaatccaagtcagcccgttaaggagaaagaaattaaggttagcggatcatgtacaagctgagtgtgaaagtagaaatcacctacaccagagagccattttggtattttgcctttaaataaaaagcctcctttatctggctgtgcagccttgctctgtggcttttcccaacacaatcagtgctagtgctggggaggaacagtcaagagcagtcagttgcttgcttattttttctggatgagtctgggacacactgtaactttaacacatttaagaagtaggtgtgtggccttttcagaaggtggcatggtcctcaagtgagttcttagtattttatatcagcaaaataattcaattttgcaggttgcaaacaaatataaaacctgtttctgtttatgaatattattcttttagaatagaataagtacatgctgctgtaataaaattgcctttaatcacttaacaagcctaaccttgactcaaacagtgaatgcctatagaaataataaatgaaaaaaactagtatttttatatcataaaacaatgtcatttatagcttatcattcatgtattgtccagcagacattaaaagccctgtggataattaagttatcttcatacctgcaaaatggtggaggctattttcattaaaactgtcagaatttgcttactataattatgatacagtccaaagaatgcagtcactttttatcatgttaactaattgttctcttttgaagatctatggttgactaattaaacaataattcaagtagagtgtcccagaaaaaaaccacttgggctccctgtttggagtctggctggctctgagcattgccaatggcccctactcacctgactttgtatcctctccttttagaggctttgcattctgcacccagcttcactaacagtgggctgaaaacatccttgggttgagtgtttcatttgggagttatttggccagggccttttgaacagtagtgtccccatgaagtgctagataatatatgtgtaagagtcagctttttttttttttttaactctaacacccttcagaaatttctaactactttgtaactgcatggcttaacctggtgataaaagcagttattaaaagtctacgttttccaaaacttaaaaaa

SEQ ID NO: 339 - DNA, 866 bp, Homo sapiens
  misc_feature: Incyte ID No: 399785.1
  unsure 18: a, t, c, g, or other
acgagacgagcacccgtngggggctggagcaccccgcgcgctcccctggcgagagggagggtcgtggctcggcccctgctcagacaaaggctgggaggcgggagacatgcacttccccttccttttcagccaggcgcgcgctgataccaggcccacgtcagctatttttggagccttttacacgacagctggaggagcgtcctttttaattttccccttttgtttggccgcccccacccccaccccttcgccttcatcgctgcacttgaggctccatcctggggcctctccttgacttgacctgccttggcaggcacatgccctccctgcctggctcactcgccgcagagacctggcagcccgcgcaaaatgtcactttgcggaatcgttcccacggcttctgggtacccttagttccctgcttagggagggaagacagtagtcgggtcgtaataagcaagacttagcccgagcctccgttgccaacgcaggctgccttgcttggcgtgtgggcatcggcctgccccctcaccctggctacccaacacagctacaaaaggcagggaacaatgtaggtcccttggccctgcctaatgcctgttgccatggaaacccctatcctaatctggccaggagccccttgcagtgagccaggagagtgaggaagaggggatggggcccgctggcctgaacctggccagaggaggtaatggttaaccggattgtgggagcagctgactagagccgggggggtagggaggcttgggccccagtcctaccttccctgccaaggagaaaggggcatgtctgcttttgtacctctgggaatctacctcagggatctgcccaacaactcccaggttcca

SEQ ID NO: 340 - DNA, 4609 bp, Homo sapiens
  misc_feature: Incyte ID No: 010498.19
  unsure 3013, 4582: a, t, c, g, or other
ggaaatctgggaatgtgcagctagccccgcttaattgatctaagcagccagggccggcaggggagctttcacgtacacagcctctattcctggcttgcaggactgttacctaaggggcaaagaagtccacctgcgaaagacaccatgttgctactacagccttagcaacagcagtagcccggttttcattgttgtggtttacagtcatgagagccatactcctttaagaaaacaccaaactcctttccctcattcctggccccaatcagtaatcaccaagactgtcagctgcctgcagttatcgggaagagcagcctggggaaagttaaaggagcacagatggacagttgctttctgcatgcaagtggccagctaggatcccggggggcatcaagccatgatttttatttctgtgctggatgcattagcagctgtgacttggaaggttttatcctgaaggagtggaattgctgcagacgtcttggggttttggtgagcagtagatatttggggacattgtgctgttattgcagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccagaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggccggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacccgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaattttnttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttatattcttcatggaatggagcccagaagaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaatcnaagagtgcagacttataattttcaaaa

SEQ ID NO: 341 - DNA, 1542 bp, Homo sapiens
  misc_feature: Incyte ID No: 255824.39
ggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctgggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggaaaaaa

SEQ ID NO: 342 - DNA, 1520 bp, Homo sapiens
  misc_feature: Incyte ID No: 2706606CB1
cccacgcgtccggaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcacccttttcgggacactgccaaataaacacgtatttc

SEQ ID NO: 343 - protein, 364 aa, Homo sapiens
  misc_feature: Incyte ID No: 2706606CD1
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 344 - DNA, 162 bp, Homo sapiens
  misc_feature: Incyte ID No: 118006.1
gtcttgaataagataatttatttttctgaagaactcaaaaggctttgcatatacatcatgtcagttaatctgatcagggccatatgcctgaaatgaacaaaacaggataaccattggaaagacatacaaatatgaaaagtgtttgtaagtggaccagcaacc

SEQ ID NO: 345 - DNA, 4143 bp, Homo sapiens
  misc_feature: Incyte ID No: 1039889.26
gcgggcgcgccgcttccgcttaaataacggggggggaggccgcggtcggtctcagtcgccgctgccaactctcgcactctgttcttccgccgctccgccgtcgcgtttctctgccggtcgcaatggaagaagagatcgccgcgctggtcattgacaatggctccggcatgtgcaaagctggttttgctggggacgacgctccccgagccgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcaggctctgttcctctcccggcatttcctccctgaagcctccagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtacccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagtctgtggcttggtgagtctgtgtggccagcagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaaaaaaaccttacataaattaagaatgaatacatttacaggcgtaaatgcaaaccgcttccaactcaaagcaagtaacagcccacggtgttctggccaaagacatcagctaagaaaggaaactgggtcctacggcttggactttccaaccctgacagacccgcaagacaaaacaactggttcttgccagcctctagagaaatcccagaacactcagccctgacacgttaataccaaggggaacagttaacttcaatacaaggtcaaaatcagcaacaagttctacaatccagtgctgatatcagatacaagcttcaaggacaatttcttttcgaaggcttattccagtttcgtgaggctagcatgaggtgtgtgcatttgccaggggcaaatttctattctcaattaacccatgcagcaaatgctacgcatctgctgagtccgtttagaagcatttgcggtggacgatggaggggcccgactcgtcgtactcctgcttgctaatccacatctgctggaaggtggacagtgaggccaggatggagccaccgatccacaccgagtacttgcgctctgggggtgcgatgatcttgatcttcatggtgctgggcgccagggcggtgatctccttctgcatcctgtcagcaatgccccggatacatggtggtgccgcccgacagcaccgtgttggcgtacaggtctttgcggatgtccacgtcacacttcatgatggagttgaaggtggtctcgtggatgccgcaagattccatacccaggaaggaaggctggaacagcgcctccggacaccggaaccgctcattgccaatggtgatgacctggccatcgggcagctcgtagctcttctccatgacaatgccagtggtgcgcccagaggcgtaaagggacagcacggcctggatggccacgtacatggccggggtgttgaaggtcctcactgagcgaggctacaggtttaacaacaacgggccgagcggggaaatcgtgcgcgacatcaaggagaagctgtgctacgtcgccctggacttcgagcaggagatggccaccgccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtcgggcggcaccaccatgtatccgggcattgccgacaggatgcagaaggagatcaccgccctggcgcccagcaccatgaagatcaagatcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactacagcagatgcgtagctttgctggcatgggttaattgagaatagaaatttgcccctggcaaatgcacacacctcatgctagcctcacgaaactggaataagccttcgaaaagaaattgtccttgaagcttgtatttgatatcagcactggattgtagaacttgttgctgattttgaccttgtattcaagttaactgttccccttggtatttgtttaataccctgtacatatctttgagttcaacctttagtacgtgtggcttggtcacttcgtggctgaggtaagaacgtgcttgtggaagacaagtctgtggcttggtgagtctgtgtggccagcagcctctgatctgtgcagggtattaacatgtcagggctgagtgttctgggatttctctagaggctggcaagaaccagttgtttttgtcttgcgggtctgtcagggttggaaagtccaagccgtaggacccagtttcctttcttagctgatgtctttggccagaacaccgtgggctgttaacttgccttgagttggaagcggtttgcatttacgcctgtaaatgtattcattcttaatttatgtaaggttttttttgtacgcaattctcgattctttaaagagatgacaacaaattttggttttctactgttatgtgagaacattaggccccagcaacacgtcattgtgtaaggaaaaataaaagtgctgccgt

SEQ ID NO: 346 - DNA, 392 bp, Homo sapiens
  misc_feature: Incyte ID No: 481480.7
  unsure 311, 324, 353, 382, 389: a, t, c, g, or other
cttattagtcatacaaataagacttatgtaagtttatgcttatttttgcctttatgactacataataatttatagaatcaactaaaatcagctatccatggtattttgcttgtattttgccttttaggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattcnatgtattgtttcnatgctcccaaaagaactctatttttatcnctaaagaatggttggttgggggttttttnagtttgnatg

SEQ ID NO: 347 - DNA, 1860 bp, Homo sapiens
  misc_feature: Incyte ID No: 662575CB1
ctcgactccggaggctcccgcagccccggcgtccgccccgctggcccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaaaaaaaaaaaaaaaaaaaaaa

SEQ ID NO: 348 - protein, 450 aa, Homo sapiens
  misc_feature: Incyte ID No: 662575CD1
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQESKRFVQWQSSI

SEQ ID NO: 349 - DNA, 875 bp, Homo sapiens
  misc_feature: Incyte ID No: 027619.3
  unsure 844, 847: a, t, c, g, or other
ctcagtcatgccagtgcctgctctgtgcctgctctgggccctgggcaatggtgacccggcctgcctcagcggcccccatgggcggcccagaactggcacagcatgaggagctgaccctgctcttccatgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccaggaacttcgggcaagcctgttggagactcagatggaggaggatattctgcagctgcaggcagaggccacagctgaggtgctgggggaggtggccccaggcacagaaggtgctacgggacagcgtgcagcggctagaagtccagctgaggagcgcctggctgggccctgcctaccgagaatttgaggtcttaaaggctcacgctgacaagcagagccacatcctatgggccctcacaggccacgtgcagcggcagaggcgggagatggtggcacagcagcatcggctgcgacagatccaggagagactccacacagcggcgctcccagcctgaatctgcctggatggaactgaggaccaatcatgctgcaaggaacacttccacgccccgtgaggcccctgtgcagggaggagctgcctgttcactgggatcagccagggcgccgggccccacttctgagcacagagcagagacagacgcaggcggggacaaaggcagaggatgtagccccattggggaggggtggaggaaggacatgtaccctttcatgcctacacacccctcattaaancanagtcgtggcatctcaaaaaaaaaaaaaa

SEQ ID NO: 350 - DNA, 8731 bp, Homo sapiens
  misc_feature: Incyte ID No: 235447.5
ggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggacggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggcagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacgacattttattttcacttatggacatacagtacatgaatttagaaataaaatcgtcgcaggattctgaaatactgataccttaagatctaacacactgatattagtccattccctacaaagcagccacattagcagttcagatttggtctttgttgtagctgttgacattaagttctttaagtgaaatgcccagcagcatttaaataatattttacagcagacatgaactaagtttcaatattccatctttggaacaaattatgcttatttacatgttaacaggtggctatatttacttaccctattgtgagtttaatgactgattttaaactacagagggttttccagctattatttcctttagtttctaaaagtaacgacttatattaatgttttataaaagatagtgatgaaaaaaaggtaatgctgaaataaaggcgcttttagaaatatttaaggacaacataaggtattaatattggaaaaaaactgtacatattttcaagcacaacactgaaatattgcagcagtgtttaactgaattgttttaaaatagtggtaattatactaccttacataccgttctaatatttaaatctcttaattacaatttgaatatacaatctgacttacaattagaactatgcacagtttccgaagcatatttttcaggtttgtttttgcacaaaaattaacgtttaagttggtccttgatttggagtactataactacctggaagcactaagttttagacacattcattgatagccaacaaaatccttgacagagtgaaaaacatcaagagtaccatgcgtgaaaaagcagctgttaccctccaagtgcaatatgaaatctagaacaagaccctctcagaggcctgcgtgtctcaatgagtgaccctcaaagaaaccaaaatgtataggaggaagtagctgaccagtcatgggcatcttccacattgggataatctttaaaacagaggcagctttggacctctagcgtaagagatagactttacattctttgattttatttacacttttttaaaaagataaagtatatctgaattctctcatcacacctaaactgctggtgcactggcagttcaagctgattaaagtcatgaggcagcccaccagagactttaaagaaccccagacctcatcctcctctttcctatcatgaagtcacagactgtctcatcaaactacttgatgtctgtaagagacttacattttataaacacagttagcttattactgaacttttaagaaaagtccaaagatgtgtggaaaagtatgcctgctaatagtgaccgcttctacaatgacaataatgaaactgagctacaaaaataattttgctgttttaaataatgaaaggagctaggtttttaaaatatattacttattctgcaacagctaattaaattgacaatcaatagaatacaatgaacagattcagcttccattctgcaagctgaattcaggttatattttaattacagaatagcttcaaattataaatctaactgtcccaatagtaaagagaccatcaaggcagtaacatcagatcaattctgtcatcatcctgcatggagcacaagatgtgcttttggataaaggcattaaaaagaccttgggctgatgtggaaagcgggtcagtaaagactccagttctgcacaatggaatcttccaagccaagccgctttccacaaatacaaattcagtctatcttttctttctggaccagtctgggagcatcgacaaaatctttgccattgtaaagaatgataaaaaatgttccaatgcttgcaactccccagaagagcacataggccagtgtttctgtccaagtgtcaccagccataagcaaacagataatgcacattgaaaaggcaacaaccatgataataggcaaagccaggaatttccagtcccttggaacacttaaaggactatgagattctaattcatccactgaatagtttccaagaaataagtctatggaatcttgtctaaatccatcggaaaagttgttcttataatatcgtatcattgagttccagccatccattataagtcccaaatgagttctctttccagttctggtaaagtcagtcttcaaggcaccagttcccgcatattgcttggcacaagcatttgcgttgtcagcccaggcatttttgaaaatcttctcaaattcatcttgttcttcaagcttttgtcccacatgcaaaactcctagtctctgaagttgggcctgaagtgaacgacgagctaacaaactctggatcacattggttctatctagacaaacatgcaattgcttcggaacacgccttcctggtttgccaccacctggccagcagagtccactagaaaataacttaattcatcttgcatttctgctacctgatccaataaaatacttagtcgatcccatctcatatttttacattccttatggaagtcaaaggcaatgtatctcatcattccacttcccaaggaagacaccattgttgcaaatgtctgctcaagtggcttctccgagcccttctggttaatcagattgattataacttgttttccataaataattacttgggaatcaaaatgcctttggaaaccgtccatgtgatttgctactttgctgatctgtggcagtggtttgtacttgaggtttggtctttgggaccagaaaacaggtattgatcctcgagtctgtacaaacgaagctttgctcccattgtagtgcacaatttgttctgtttctacaaagttagctgcatggccttccgaatcaattcctcttacataatagcgcacaccagctctgaaacagctcctcctcgagatgagaatccaatcaaagtattttccattaatagaacatgaatgcatggtaataaagccatgtaacactggaagggcaaaccgatgaacctctggctgtgcagaaagttctcttagaagatgaccattccatacaaaccgctgatctgccctttccaagagactcatttcttggaattcaggactagtgttggatagccgctgcaaagtatgggtcaaatcatatgttgttgaaaagtaaaatccatccacattcaagacatggtttagcatcgctaggaaggttttattatcttgtaactgaatatcagttaagtgcaacattgtcttcttataagaaaggacatcaaaatctgttgctttccagactacatgactgaaaaattcacctacttttatctttttggtaatgactataagataattacctgccaccagatggattgtgcccagtataccaaatattggtcttgtgacagctgaaggaggaacatctttcttgactgcaagggtaacctctgtggacacacggtcaatggtaagtacgtcatctgctccatcatcacaagcttccacataaaatttttcaggtgtgatatgccagatattcccaggctgtggccaccagattttcaaacacagcttcagctgctcgtaggccgccgtcgccatcctgcac

SEQ ID NO: 351 - DNA, 3786 bp, Homo sapiens
  misc_feature: Incyte ID No: 331104.2
  unsure 2577: a, t, c, g, or other
agcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcnattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataagtcctattgataaaggtcagatggagccctagagtgtattactgcatctatttttttccccgagaagataaaggaccttcagggatggcttaagtgtatctgtccagatgaaggatgggtcacatgacctcttggcttcccaagtctaagctctgtgactttgcaccagtgtgtgcatatatgtgcaaggcccttcaagtggtctgaaaccgtggctctaaaaaccacagctggtggagaggaggacagacacacttgccaccttgcctacctaattgccatctaaaatgggccgaacagtggatttcacaatagagttttcaccctttagatttacaacctgtcaggtggaaactgaagtgaaaactgctgcacacagcaattcagggagcaaaaaatgtgctgaggagactgtttacctaaaggttgttcttggtgctattccttgtcaaaatgtgaacacacacaaatgaggtttgtgcattgtcatccgtgggctgccattgagccagtaacccccagtggtctcatggtgctcttcgctccagtttggggaatgctggattctttcagcccctgcagccctccaggtcaaaatgacactttgtcactgagttttctacacagctctattagtaactgacagcacacgccttcaagggaacttcaagggaaacatggaataaactaagtctcaattgc

SEQ ID NO: 352 - DNA, 416 bp, Homo sapiens
  misc_feature: Incyte ID No: 348390.2
attgctctggtattcatgccaaagacacaccagccctcagtcactgggagaagaacctctcataccctcggtgctccagtccccagctgcattcagccacatacaccatgtgtgaagaggagaccaccgcgctcgtgtgtgacaatggctctggcctgtgcaaggcaggcttgcgcaggagatgatgccccccgggctgtcttgcccctgccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcac

SEQ ID NO: 353 - DNA, 833 bp, Homo sapiens
  misc_feature: Incyte ID No: 127004.1
  unsure 666: a, t, c, g, or other
atttgagcctgtgaaataatttttaacacatttattaatggagaataatcaatattttgtgattaaatatatatgtattaatcagatatgtgttcttgcacattctttaaagttaagcgaatatgagtaacttgaagaagttagaaacaaaccaaataaaactaatagtaaaatgttaaatgcttgtcaattgagttctacttctagacctacagtgtcaatgatggtaagataaattcctctttgtatcacacactttaaaatgctgaaatatatataacacatggctgagccaaaataaatgtgaaaaaatattgaagacgcaagaataatagctggataagggagctctagaacattactggaacagtaagctggaacagacttctaatttcagccttgaaatggaacgagcttgtaagtcatcacttccattcttacaaaaagaaaaagctaaataaactgaataacaatcacttttcttggaccagtcagaatattaaagttcccagggaatctatcatactttgaaacctggaaagagacagacaaatacagaaaatcataggcaagatcagttcacctgaacagaagctgatgggactgtgaaatgttctctaatattaaaaataggcaacattcaagaacagacgggtaatataagcngaaagatagaaactttaaaaaatcaaaatcaaaaggatattatgctagaaataagaaataaacaaaactaacagaaaggaagaatgtgtttcatggccttatcagtagcttggcacagctgaggaaggaatcagtgagctttaaggtatccaataggtaaaaccctc

SEQ ID NO: 354 - DNA, 1359 bp, Homo sapiens
  misc_feature: Incyte ID No: 026190.1
  unsure 198: a, t, c, g, or other
gaaaggtatgaactattgtcataacttaggagtgagtgggaaaggtagaactatgtcataacccttaggagtgagtgagaaaggtagaactatgtcataactcttaggagtgagtgggaaaggtagaactatgtcataactcttaggagtgagtgggaaaggtagaactatgtcataactcttaggagtgagtggggnaggtagaactatgtcataactcttaggagtgagtgagcaaggtagaactactcgtcataactcttaggagtgagtggggaaggtagaactatgtcataacccttaggagtgagtgagaaaggtagaactatgtcataacccttaggagtgagtgaggaaggtagaactatgtcataagccttaggagtgagtggggaaggtagaactatgtcataacttaggagtgagtggagaaggtagaactatgtcataactcttagaagtgagtgggaaaggtagaactatgtcataactcttaggagtgagtgaggaaggtagaactatgtcataacccttaggagtgagtggggaaggtagaactatgtcataacccttaggagtgagtgaggaaggtagaactatgtcataagccttaggagtgagtggggaaggtagaactatgtcataactcttaggagtgagtgagaaaggtagaactatgtcataagccttaggagtgagtggggaaggtagaactatgtcataactcttaggagtgagtgagaaaggtagaactatgtcataactcttaggagtgagtggggaaggtagaactatgtcataactcttaggagtgagtgagaaaggtagaactatgtcataacccttaggagtgagtgagaaaggtagaactatgtcataactcttaggagtgagtggggaaggtagaactatgtcataactcttaggagtgagtgaggaaggtagaactatgtcataacccttaggagtgagtggggaaggtagaactatgtcataactcttaggagtgagtggggaaggtagaactatgtcataactcttaggagtgagtggggaaggtagaactatgtcataagccttaggagtgagtgagaaaggtagaactatgtcataacccttaggagtgagtggggaaggtagaactatgtcataacccttaggagtgagtgaggaaggtagaactatgtcataacccttaggagtgagtggggaaggtagaactatgtcataactcttaggagtgagtggggaaggtagaactatgtcataactcttaggagtgagtggggaaggtagaactatgtcttaactcttaggagtgagtgagaaaggtagaactatgtcataacccttaggagt

SEQ ID NO: 355 - DNA, 554 bp, Homo sapiens
  misc_feature: Incyte ID No: 250330.1
  unsure 524: a, t, c, g, or other
ccgagagaagaaaagcaggtggaaggagaggaagcggatgccgtgggggtaagctaagttctttccttctgtggtctttgagcatgtcgagtcacccgggtacatgtttctgctgtgtctgtggatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaatataataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagtcaccgcgccccggcatgaaagggnttttccattaaaaatccttgttataccgtg

SEQ ID NO: 356 - DNA, 548 bp, Homo sapiens
  misc_feature: Incyte ID No: 480375.28
  unsure 374, 491: a, t, c, g, or other
tttactaccaaatgatctccttgaaaaagtggattcaattaatgaaaaatgggaactgcttggggtatttgcatttttattactgtttgtaggttatgtgtacattttttgcgtagtgaagtactctgtccgatttctaatttgaggcacaaatatctctctctttcaattcactacctacgtttcaaacaagctattcatgctattatgggaaagacactgcttttcctcttctgttgattttttttttttctgagcttgtcccctctcagattttaataattttggttctttaatacatgaaaaagtaagtaaaatatgccatgtattatgggtatgcaccaagtcaactataatacagtatatctgatatntactgactgtcatgcttgaatgaatgttaatagaatttattctgaaggtacatgtgagagacatctactgtttaactatttactgtacccttaagatgaaaagtggagttgtcactncagctttcaagtcacactaaagccaccaaaacaaagatgcaaatttgacccaaatct

SEQ ID NO: 357 - DNA, 1770 bp, Homo sapiens
  misc_feature: Incyte ID No: 364726.10
cacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaaattattgaacaggataagcatgcactactggatgtgactccgaaagctgtggacctgttgaattacacccagtggttcccaattgtgatttttttcaacccagactccagacaaggtgtcaaaaccatgagacaaaggttaaatccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggaggtgaggcgaggcaggccacgggcaggaacaggagagcctggtgttttccttgcactctcgtggacagctgtgtgttcagggtgctgtggaaggcattcctaagggttggagcagatgacttccagggagtctctcgctttgagtccacgctggcatggttgcagtctgtgggaaagtggggcaggcaggtggacttcagaagagcttgaggggtcagcactccgcacacccatgccctcaggtgcgatggataaacagaatggctttaggtgccgtctgtccaaattaccagcggaaccttccttcccatgcagtattgttgtatgtacttgtaacctttgattaggtttctctctgtactcttagatgtccttgcttttcttccccatcctgcctttaacctttctaatcttgccaaagctcttgagtgtttccccatcagtttccttctctcttatatttcagttttttaattgagttcatgatcaaaccttcatctgatcacatcacatgtactgtgcatccactgtgattagatagcttatgggatccttgaaatcacattgacaggcactgtaaagtcacagccaagttagcaattattagttgcacctcagagaatgttggaataatgatctttgaagatgggattgttcatatatttggataattattgctgtggatttctctctagcattttagctcattccagtaaatgatttttttctttatgaaatagaactaccac

SEQ ID NO: 358 - DNA, 4530 bp, Homo sapiens
  misc_feature: Incyte ID No: 364726.12
cgggtcggcaccccggcggttgggctgcgggtcagagcactgtccggtggtgcccaggaggagtaggagcaggagcagaagcagaagcggggtccggagctgcgcgcctacgcgggacctgtgtccgaaatgccggtgcgaggagaccgcgggtttccaccccggcgggagctgtcaggttggctccgcgccccaggcatggaagagctgatatgggaacagtacactgtgaccctacaaaaggattccaaaagaggatttggaattgcagtgtccggaggcagagacaacccccactttgaaaatggagaaacgtcaattgtcatttctgatgtgctcccgggtgggcctgctgatgggctgctccaagaaaatgacagagtggtcatggtcaatggcacccccatggaggatgtgcttcattcgtttgcagttcagcagctcagaaaaagtgggaaggtcgctgctattgtggtcaagaggccccggaaggtccaggtggccgcacttcaggccagccctcccctggatcaggatgaccgggcttttgaggtgatggacgagtttgatggcagaagtttccggagtggctacagcgagaggagccggctgaacagccatggggggcgcagccgcagctgggaggacagcccggaaagggggcgtccccatgagcgggcccggagccgggagcgggacctcagccgggaccggagccgtggccggagcctggagcggggcctggaccaagaccatgcgcgcacccgagaccgcagccgtggccggagcctggagcggggcctggaccacgactttgggccatcccgggaccgggaccgtgaccgcagccgcggccggagcattgaccaggactacgagcgagcctatcaccgggcctacgacccagactacgagcgggcctacagcccggagtacaggcgcggggcccgccacgatgcccgctctcggggaccccgaagccgcagccgcgagcacccgcactcacggagccccagccccgagcctagggggcggccggggcccatcggggtcctcctgatgaaaagcagagcgaacgaagagtatggtctccggcttgggagtcagatcttcgtaaaggaaatgacccgaacgggtctggcaactaaagatggcaaccttcacgaaggagacataattctcaagatcaatgggactgtaactgagaacatgtctttaacggatgctcgaaaattgatagaaaagtcaagaggaaaactacagctagtggtgttgagagacagccagcagaccctcatcaacatcccgtcattaaatgacagtgactcagaaatagaagatatttcagaaatagagtcaaaccgatcattttctccagaggagagacgtcatcagtattctgattatgattatcattcctcaagtgagaagctgaaggaaaggccaagttccagagaggacacgccgagcagattgtccaggatgggtgcgacacccactccctttaagtccacaggggatattgcaggcacagttgtcccagagaccaacaaggaacccagataccaagaggaccccccagctcctcaaccaaaagcagccccgagaacttttcttcgtcctagtcctgaagatgaagcaatatatggccctaataccaaaatggtaaggttcaagaagggagacagcgtgggcctccggttggctggtggcaatgatgtcgggatatttgttgctggcattcaagaagggacctcggcggagcaggagggccttcaagaaggagaccagattctgaaggtgaacacacaggatttcagaggattagtgcgggaggatgccgttctctacctgttagaaatccctaaaggtgaaatggtgaccattttagctcagagccgagccgatgtgtatagagacatcctggcttgtggcagaggggattcgttttttataagaagccactttgaatgtgagaaggaaactccacagagcctggccttcaccagaggggaggtcttccgagtggtagacacactgtatgacggcaagctgggcaactggctggctgtgaggattgggaacgagttggagaaaggcttaatccccaacaagagcagagctgaacaaatggccagtgttcaaaatgcccagagagacaacgctggggaccgggcagatttctggagaatgcgtggccagaggtctggggtgaagaagaacctgaggaaaagtcgggaagacctcacagctgttgtgtctgtcagcaccaagttcccagcttatgagagggttttgctgcgagaagctggtttcaagagacctgtggtcttattcggccccatagctgatatagcaatggaaaaattggctaatgagttacctgactggtttcaaactgctaaaacggaaccaaaagatgcaggatctgagaaatccactggagtggtccggttaaataccgtgaggcaagttattgaacaggataagcatgcactactggatgtgactccgaaagctgtggacctgttgaattacacccagtggttctcaattgtgatttctttcacgccagactccagacaaggtgtcaacaccatgagacaaaggttagacccaacgtccaacaaaagttctcgaaagttatttgatcaagccaacaagcttaaaaaaacgtgtgcacacctttttacagctacaatcaacctaaattcagccaatgatagctggtttggcagcttaaaggacactattcagcatcagcaaggagaagcggtttgggtctctgaaggaaagatggaagggatggatgatgaccccgaagaccgcatgtcctacttaaccgccatgggcgcggactatctgagttgcgacagccgcctcatcagtgactttgaagacacggacggtgaaggaggcgcctacactgacaatgagctggatgagccagccgaggagccgctggtgtcgtccatcacccgctcctcggagccggtgcagcacgaggagagcataaggaaacccagcccagagccacgagctcagatgaggagggctgctagcagcgatcaacttagggacaatagcccgcccccagcattcaagccagagccgcccaaggccaaaacccagaacaaagaagaatcctatgacttctccaaatcctatgaatataagtcaaacccctctgccgttgctggtaatgaaactcctggggcatctaccaaaggttatcctcctcctgttgcagcaaaacctacctttgggcggtctatactgaagccctccactcccatccctcctcaagagggtgaggaggtgggagagagcagtgaggagcaagataatgctcccaaatcagtcctgggcaaagtcaaaatatttgagaagatggatcacaaggccaggttacagagaatgcaggagctccaggaagcacagaatgcaaggatcgaaattgcccagaagcatcctgatatctatgcagttccaatcaaaacgcacaagccagaccctggcacgccccagcacacgagttccagaccccctgagccacagaaagctccttccagaccttatcaggataccagaggaagttatggcagtgatgccgaggaggaggagtaccgccagcagctgtcagaacactccaagcgcggttactatggccagtctgcccgataccgggacacagaattatagatgtctgagcacggactctcccaggcctgcctgcatggcatcagactagccactcctgccaggccgccgggatggttcttctccagttagaatgcaccatggagacgtggtgggactccagctcgtgtgtcctcatggagaacccaggggacagctggtgcaaattcagaactgagggctctgtttgtgggactgggttagaggagtctgtggctttttgttcagaattaagcagaacactgcagtcagatcctgttacttgcttcagtggaccgaaatctgtattctgtttgcgtacttgtaatatgtatattaagaagcaataactatttttcctcattaatagctgccttcaaggactgtttcagtgtgagtcagaatgtgaaaaaggaataaaaaatactgttgggctcaaactaaattcaaagaagtactttattgcaactcttttaagtgccttggatgagaagtgtcttaaattttcttcctttgaagctttaggcagagccataatggactaaaacattttgactaagtttttataccagcttaatagctgtagttttccctgcactgtgtcatcttttcaaggcatttgtctttgtaatattttccataaatttggactgtctatatcataactatacttgatagtttggctataagtgctcaatagcttgaagcccaagaagttggtatcgaaatttgttgtttgtttaaacccaagtgctgcacaaaagcagatacttgaggaaaacactatttccaaaagcacatgtattgacaacagttttataatttaataaaaaggaatacattgcaatccgt

SEQ ID NO: 359 - DNA, 3693 bp, Homo sapiens
  misc_feature: Incyte ID No: 1505038CB1
cgatcggcggactcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcatctcagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgctcccaccctgccacatactagatgcagcccatagttggcccccctagcttccagcagtccactatctgccagaggagcaagggtgccttagacctaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcgacttctgtgattattaaccccactcactaccctgtttcagatgcatttggaataccaaagattaaatccttgacataagatctcatttgcagaaagcagattaaagaccatcagaaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaaccttcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgaaaaaaaaaaaa

SEQ ID NO: 360 - protein, 308 aa, Homo sapiens
  misc_feature: Incyte ID No: 1505038CD1
MWKRWLALALALVAVAWVRAEEELRSKSKICANVFCGAGRECAVTEKGEPTCLCIEQCKPHKRPVCGSNGKTYLNHCELHRDACLTGSKIQVDYDGHCKEKKSVSPSASPVVCYQSNRDELRRRIIQWLEAEIISDGWFSKGSNYSEILDKYFKNFDNGDSRLDSSEFLKFVEQNETAINITTYPDQENNKLLRGLCVDALIELSDENADWKLSFQEFLKCLNPSFNPPEKKCALEDETYADGAETEVDCNRCVCACGNWVCTAMTCDGKNQKGAQTQTEEEMTRYVQELQKHQETAEKTKRVSTKEI

SEQ ID NO: 361 - DNA, 3123 bp, Homo sapiens
  misc_feature: Incyte ID No: 903508.12
  unsure 29, 208, 234, 241, 244, 257, 279, 297, 307-308, 310, 327, 330, 332: a, t, c, g, or other
agctctaccacctatttcaaaaggaatangccacacagataatgtctcctatgagcattccttcaacaaaagggggatcactcagacagtgcttccatggacaagtccttgtcaaaactggcccatgctgatggagatcaaacatcaatcatccctgtccatcaggtcattgataaggtcaaggggtattgcaatgctcattcagacnacttctataaaaatattatcatgtcngacaccntcngccacagcacaangttttaatgtctttaagaaaangaaatcaatctgcagaantgtgaagatnngnaagcagtgtaaactgcnacnantgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagaaaactttcccaaaatgttgacctagttaaatgaggctatataaatttctaatattttacttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttccaagttattcaattcctttatgagtgaatgtttttacttttgactcctaaataggaaaagattatttgacagctggaaaataacctgccaccaattaagcgagtgacatagggctacttt

SEQ ID NO: 362 - DNA, 7066 bp, Homo sapiens
  misc_feature: Incyte ID No: 346716.17c
atgttgttcttgtttctgggccctctggcccaggagtatggctgtgtgtttatcctctttgttttgcctggttccttcctcttccccaagttcgtcataacttgatgataaaatcaatctttaagtttcacagtttgtttgccacaatacactggcagtttttaactaagtggcttgtcagggtagtggacatgctttatcagcacactgcccacctattttataatctggggcatgtcactccaagcttgagatttctttctggcaagttccatccaggatggctgatctgtactggcataactggctctcttcagctgatgcagttccttctccatcatcactgcagactgagccaagttctgatgggacaatgagattcctctttgcagcccctccttgaagttgagctttgccccctgcttccggtccacagcgggcttcacaggggttatcaggaaagacttgctgcgaacaaagtcagcttgcttcacaggctcctggcctctctcgggcaccttggcttgctttcctggttcagacttcagggtccgtgccccaggcttgtcttcctggttgggtggctggtccaaggtccccctccgcttctgccgagtgacggtgatccagggtggcgcaggctgcccatcagctccaggccctgttgctgcaggcggcagactcttttcagctcccctgcgcagcggccttttctccgccgtcctgggctccttcctgggttcccgctctcccgggccggcgtcggggggcgcgggctggtgcgggagcgtgaagctctgcagaagcggcttccggggcaggggcggcttggagctgagcggctcggggggccgggccttcccctttccttggtcgctgggggccctggtgcctcgaagggcgggggtccgtcccgaggggacacttctgcctccttcgggagcacggtcagcgacctttctaaccggacctcggcactgtacctcttcacacccttcacctcctgagaggcgccatccctgtatttgagcgagagggaggtggaccggagcttgacggggaaggggtttctgtcctcactcggggccggctcctgggcggctgggcagggctctctcgtgccgggcgcggcggccgcctcctgagggctcttgcgcggcccggccgggctggccgccctgtcccccgagtcctgagggccgcgctccgccagcttccgagggccaggtttcgcgtgctggggctcggggagaccctggaggtcgtcaagagccggcccgctcctccagcaggctctcgggtcttggggctcttgttagcattttgtcgcaggagcgaaagcctgcggaaggcgatactctctgcagcctccagttggctgatctcctccatcttcactttgtatttcctcatctgctccttgatcagcatctccacgcacgtggtgatcttgaggacgtccttcatgctggtcagcgggtccgagttgtcagggcagcgcaggaggcagggtgcgaagataatggccagcgccccaggtgacatgcggttgacatcctcgagcagggccaccttgacaaggtggaagatgagtctctccagggagttgtggttggcttctggaaggtgctccaggacggcatagatggcagccagctgctcctgcttctccggcagctcgacggctcggaggaagtcgccgtactgtgcgaaggtcatgaggggctcgggcagctcccgcagccactgcttcagcacccctgtgatggcgtggatggggaagttctccagcttgactgctgcggggtctgtctgcagcgcctgccggagctcccgagtgcggttggcagcacccgacttgcggtagaggccctcggtgtacaggccgtgcatctccacgtgttccaggagcttctccagcacgatgggcaccgaggccttgtcgctggtcaggctgtctacgcacacgccgaagtggccaggctcagcgcctggctcgcccttcctcccgtaggtgtaggagcagtggctctgaatcttgtgcacgcacttcttgtggcaggtcatcttgcacacgctgcagagcagggccttgtccatgagccagatataggagaggcactgctcgcacgactgcgggatgctaacctggtagctggcgaacacgtgcccgttgtgctcctggacagcacgctcctgcttccgcttcttcttctgagctttgctctgcttcactggctcgaagtcgttcttggtgtagccacgggtgaactcatctagcagtgactggaagaggttgaggaccaggttggtgtccttctggccacgctcagtggccaggttgctgacaacgatctggtagttctccatcagatccttgtagcccacgtggatcttcccgttcgggacagagtacatcgttttgatgttgctcctgaacttctcggtggcttcgataaacaagctctcaatgggcgtcttctgggaacggaggtcatttatcttgttgagcaggaactcgtccaggtacttgagctcattggcgttggtgatctggcggaacaccgattcccgccacttctctgacactgtgatcttcccaatcttgacatttcggttcttcttccctttgcctcctggttccttggtgcgcttctcacctgcagcgtggcgatgctgctgtccggagggggcttccaggcccttcttcatggtggtggcttccagcaccacgtgcccggacactgcattctccagctcctctgctccctccaggctgtattttttatccttggttttatgcagaaaaagcctcttaaacgtggatttagagtcgacctgagagcccggggacagccctgcgtctgggagggaggatgcgtcgcctggcttcttcttctggacagctggctttttcgcacttcgctctccgtccgtggtttctgctgcaggctgagccttggccagggacgggaggagcttggagacgtcgctcgtggagaaggaggtgcgcctctcctctgtgggcgtgagggcggcccctgtggcccggtgtctgtcgctgaggtccagggactggctgagcatggcactagggctggcggcggccaccagcttcttgccccgccacagttccacggcgctggccagccgctcggcgtccaggtaccgctggatctgcgtggagcctccggggctgtcgggcttttcctgaacccttgggctgccacatggtttgctcttgtcctcgggggtctcgggggcgctgccgggggccggtgggctgaccctgctgtccagggccaggctggtcggccgctccaactggccaggcctggggctcccactgggcagcgtcttctcagtttcttcagagaccttgccaactgccatggcctggggttgctctgtgggctgcttttgagatgtgttctcagcctccgtctctacgactagaagggtttcatcttctctgctctcctttttgtcttccaggagactcaccccttgctcctgggtgacccttctggaaggttctctgagggcactctcctccttgcaggactggatgtgtttgttctggaacttgacgtgctccagccctctttgccgacgcgactcacgcttctcccggctgctggggactttctcgtgactttcagccgccacggttttctggggtgggagagtcttctctgggcttggggcctccttctcaggtgaggagtgctctaggggggacctgtcacttggctgcacctcaggctccgatgccaggtgcccgccatcctccgctggctccggcccctgctcagctacctgctgccctccagccgcctgaccctgtccgccctcctcagcgcctgctcttgcggcttccagggcttccctctccttctcttctgccttctgcttctccgagatcatctggctgaagctcttgcgctgcaggtgcccccgacacaggctctgcaggcggatgatgctctgtttctggtgccggtagagcttccgctgccagtagcccctccatgcggcctggaggtacacggcagcctgcgtcctctccagcgccctccggacccggtaggaccgccagcaggcctggatggtgacggcggcccgcttcatctgcaggaagtgccgacgctccagcaccatccggaaccagctctgcagcagcaggattttccgcaccacctcccggtgcagcgtctcctgcagggcttgccgctccgtctccttcaggaagaccttggtcttcccgatctggtagttcctcttgtctatcttcattttctccaggagggtggagatgacctccctgcagggctgggcatccttgggcaggagcacctggaactgctcggtgaaatcctggaacgtgtacttggcgctgtaccctgacctccggatgcgcacggtctccagcatgccggtgtagcgcagctgctgcaggaccagctcgtcgtcaaagcacagctctttcttttcagcattggaacggatgcagcggataaagaagggctccgccttccccagtgcctccaagagcttgttaagggatgtctggaactgggcgctgatgcttggtggctttttcttcttgtgcaggtgcagtagggacttggtggtgcggtcgtgcagagtcatgctgatgatgagtttcagggacttggagtccagtaggttctttggaattgatctgcttttgtttgatacctttacttttcaggatgaaggcgcggggtttctggagccgactgagggactggagaaggctacgggggtcctcgccctgccagggcaatcctttgatgctcttgatcatttggttatgcaaatcgcggtaaagtttttccgaaggggtgctggctcctcttggcagctcttctgggtgactttgggcaccagggctgctcatacctgcagccttttcggccctctcggcccgcaggcgtccggcctcccgaagcactgccatggcccggatagcagcccggagcacggcccagcggaacacggccacggggtccatgccgatgagctcccgcacgtaggagctgtcactgccccgcagcagggccacgatgtctggccgcatgtagtccatgttcttctcccggaagtccttgatctgatatttcaccttccctgcgaagtgctggatgatgaaagctggctccatgaccggggtgcccaggaagtacttattgtcctcatgttgctgtttgaacttggccagcagggtctggctcgtggcgtgggggaagttgctctcctcgtccagcaggtagaagaggcccgtgggtttcttgctgatgagatggatgcagccgacattgtctgtgtagccgatgttgtgccacgtgatcccctcgccctgatattcctcctgctccagcttgaagatgtgctggttgaagtaatactgaagctgctcattggcgtagttgatgcagaactgctcaaagctgttcctctcgaagtcttcaaacccgaagatgtccaggaccccaatggacaggcacgagactgcctcttccacgtccttcttgttgaggagtgcgtggttgatccgcagcacaatccagtcgaacagggcgctgtacagagacttggccatggagtcgcgggcagtgatggcctcgctgaggctgtagggaaggataagcttgtcgttgacggtcaccgtttttcttttggtcagaacctccaccaagatttctcgcttcaccttcagaagctgcgacagggtgtccagcacctcgggtggcccgaactccaagccttcctctcgggctgtagctctcttcttataagtgacgttgcccaggtacaggatggccgagaggacggcaaaaatctgcttcttggtggcggggaggaagcccaccatctccatggcctgcttgagcctctcaaagtcatgcttcaggtcctccccatcttcaatcttcaagttatgctggttgaggtagaaataatcttcaggctgcttgagctgaaattcttggcgctcttcctcgctgaccccaagtaacaaataataaaacacatggtagttcctctcatccttctcctgagacaccaggcgagacttttcaagcagatatttctcgacgacagctcctctcacgatgccactctctaggtagctgacttggatgaatttcccaaaccggctggagttgttgttgtgggctgtcttggcatttccaaaagcctccagcacagggccagcacccaggatggtcctctcgacgccgctggcgtagcccttctggctgagggcggtgaggcagtggatgaggaagttggtgctctgggtcttgccggagccgctctcacccgagatcacgatgcactggttcacgcgcttcctgagcatggtgtagtaggccacgtcggccagcgcgaagacgtgtggctccagcttgcccagctgctggttctcatacatcttcacgtacttggggttgtagatgggcaggaacttaaaggggttgatggccaccaggatgctccccgcgtacgtgtagatcttttgttgcaggaagcggtgcttgaggttcttcaggaggttgccctcggttagctcggggaggttacacaggtcatcaaagtccgcctgctgccgtggcaggaggccacgctccactaggcgccgggtggctgtggcctgcgccaccagctgcatatgcacgtacttgatggttccatctgcgttgcgctcctgcagcaggaagtagtagccatcctcctgagggtgctcgtcctgtgcccgccggggccatagcagcacccggtgcacaggcgagtcgttggcgtccagcacccattcctcgcctcccgactctttgacctccaccagcacataacatttggtgccgtccagccgcaggctggcaatggcgtccttgatgacgtccgaggtggtgctgtccttggtggcagtcacgcggcacgaggcctggctctcggtggtggacagctgggggtagatgtgcaggtggtaggccgcctgctcccggcggcccgagctgcctgcctctttcacactcat

SEQ ID NO: 363 - DNA, 843 bp, Homo sapiens
  misc_feature: Incyte ID No: 346716.21c
gaattccagaacttggctcagtctgcagtgatgatggagaaggaactgcatcagctgaagagagccagttatgccagtacagatcagccatcctggatggaacttgccagaaagaaatctcaagcttggagtgacatgccccagattataaaataggtgggcagtgtgctgataaagcatgtccactaccctgacaagccacttagttaaaaactgccagtgtattgtggcaaacaaactgtgaaacttaaagattgattttatcatcaagttatgacgaacttggggaagaggaaggaaccaggcaaaacaaagaggataaacacacagccatactcctgggccagagggcccagaaacaagaacaacattgaaaaagtccaggaaccagttcctgtgcccaaaggtacgaatgtgtcttttcgaattcccttgataaagaagcctcagacaaggaagaaaatagaaatgaaattggacacataaataggacacccagcaaaggccagaagagaagcccttctaggagaagggacatctgtgcttccagctgagatcagcccatgtctctggtcgctctcttgcctgtggatcctgtcttctttcatgtttactacgaggcatgacattcatggcaaaacagggatgccgtttccaagagcagctataaaacaatctgttttcctaaagacagccactctgagaaggagatgaaggaacacggcagggttcatcaattcatagactgtttccaaaaataatttttaaacttttccactaggcatctgtgtctttaaccactgcacaatgcattgcctgtttaataaaaggtttcaaacatga

SEQ ID NO: 364 - DNA, 2362 bp, Homo sapiens
  misc_feature: Incyte ID No: 330776.1
tttttttttttttacatgacactttaaaagatttattcagaagtttaatatattcacaaggtacaaactttaaagttacaaaaaaggcatagagtgaaaagtctaccccagttccctggtcactcatttttgctccagccactcacttctgctctttgtaagcgatagtcttgccagtgtcttgtgtctctttccagagactatgtagaagcaaataattttttatttaaaaatgtttatatttgaataggtgatacatatagatggcaagaaaattcaaaagggcaggcagtgaaaattttcttcgctcacccacagttccccagtttctgtgtttccctctgcagagacagtcatcctttcttatatatccttctggatgttgtaagtgattgtagagcatctctgtggaaataaatggttaagtcggtttgaagcaaagcccttctggggcagaaaagcctccagaacgccagatgtcgctgtggttccgcggtgagagagggcgtgcgtctctgtggttataaagttgggggtggagtggccgggagatgatggctgatgaagaggaagaagtcaagccgatcttgcagaaattgcaggaactcgtggatcagctctactcatttcgagactgctatttcgagacacatagtgttgaggatgctgggaggaagcaacaggatgtgcagaaggagatggagaaaaccctacagcagatggaagaagtagtgggttctgtccagggcaaggcacaagttctaatgctaactgggaaagcactaaatgtgactcctgactatagccctaaggctgaggagcttctgtcaaaggctgtgaagctggagcccgagctggtggaagcctggaaccagctgggtgaggtgtactggaaaaaaggggatgttgcagctgcccacacctgcttctcaggagccctcacccattgcaggaacaaagtctccttgcaaaacctgtcaatggtgcttcgtcagctgcggactgacactgaagatgaacattctcaccatgtcatggacagtgtccgacaggctaagttggctgttcagatggatgtccatgatggccgctcctggtatattcttgggaattcatatctttccctttacttctctactggccagaaccctaagatctcccagcaagccctcagtgcctatgcccaagcagagaaagttgacagaaaagcttctagcaatcctgaccttcatctgaacagggcgacgttgcataaatatgaagagagttatggggaggccctggagggcttctctcgggctgcagccctggaccctgcctggccagagccccggcaacgagagcaacaacttctggaattcctggatagattaaccagcctccttgagagtaagggaaaggtgaagaccaaaaagctgcagagcatgctgggaagcttgcgcccagcccatctaggcccttgcagtgatgggcactatcagtcagcctctgggcagaaagtgaccctggagctcaagccactgagtacgcttcagcctggggtgaacagcggtgccgtcatcctgggaaaggtggtatttagcctcaccacagaggagaaagtcccctttacatttggcctggtagattcagatggaccttgctatgcagtgatggtgtacaatatagtgcagagctggggagtgctcattggagactctgtagccattcctgagcccaacctgcggcttcaccgaattcagcacaaaggaaaggactattccttttccagtgttcgagtggagacgcccctcctgctagtggtgaatgggaagcctcagggatccagcagccaggctgttgccacagtggcatcgcgaccacagtgtgaatgacctttgacttgcatgctcaacagggagtggaggagaggagacaaggctctggacagccggtccagccacatccagtgattcagcagggatgggaggaatgttttaaatgaagactttctctttccctgcctgtattacacttcgtatctcttctctctcctctgtcctcatcatgttccagctctctacagggccacatactcttctggcatatctctcctgtctcttccactgctctctatgttttaagcaaagagcatggaattggtagaagtcttgggatcttgccatgggacagagtccccaaggttcctgttgttgcctccttcctaagcctcatatgtatatatcagttcagtatttattgctaaaggagggggcttaattttgtaatggcttttatttttagcaatttttatttttatttttgaactttaggtccttcctcttctttggggctggaacagaattaaatttgtttggaaaaa

SEQ ID NO: 365 - DNA, 368 bp, Homo sapiens
  misc_feature: Incyte ID No: 407999.1c
  unsure 51, 79, 135, 141, 178, 181-182, 184-185, 212, 299, 332, 359, 361: a, t, c, g, or other
gccctttttttttttttttcgtccagtatctagcaaggccatcagtataangggcttattaaatgtttactgagtgaantgtgtagagcagttttgcaactttaacttgaattcctaggaacctgatcctaattnacattngcaaagatactaaagttttgaattttctagtttgtcngtnntnnctaatctggactttttgactttaactnaaatttctagctggagtgaaatggtaagctccttgcccttttaaatcaccatttgtgcagccttattctaattaccttaggcctctnccattgtggccatctaatcttctttatttggancagaagttcatcaatacatatagtttncnttttcat

SEQ ID NO: 366 - DNA, 6348 bp, Homo sapiens
  misc_feature: Incyte ID No: 1719478CB1
ctcttatgtgaggagctgaagaggaattaaaatatacaggatgaaaagatggcaatgttgcctcccccaggacctcagagctttgtccatttcacaaaacagtctcttgccctcattgaacaacgcattgctgaaagaaaatcaaaggaacccaaagaagaaaagaaagatgatgatgaagaagccccaaagccaagcagtgacttggaagctggcaaacaactgcccttcatctatggggacattcctcccggcatggtgtcagagcccctggaggacttggacccctactatgcagacaaaaagactttcatagtattgaacaaagggaaaacaatcttccgtttcaatgccacacctgctttatatatgctttctcctttcagtcctctaagaagaatatctattaagattttagtacactccttattcagcatgctcatcatgtgcactattctgacaaactgcatatttatgaccatgaataacccgccggactggaccaaaaatgtcgagtacacttttactggaatatatacttttgaatcacttgtaaaaatccttgcaagaggcttctgtgtaggagaattcacttttcttcgtgacccgtggaactggctggattttgtcgtcattgtttttgcgtatttaacagaatttgtaaacctaggcaatgtttcagctcttcgaactttcagagtattgagagctttgaaaactatttctgtaatcccaggcctgaagacaattgtaggggctttgatccagtcagtgaagaagctttctgatgtcatgatcctgactgtgttctgtctgagtgtgtttgcactaattggactacagctgttcatgggaaacctgaagcataaatgttttcgaaattcacttgaaaataatgaaacattagaaagcataatgaataccctagagagtgaagaagactttagaaaatatttttattacttggaaggatccaaagatgctctcctttgtggtttcagcacagattcaggtcagtgtccagaggggtacacctgtgtgaaaattggcagaaaccctgattatggctacacgagctttgacactttcagctgggccttcttagccttgtttaggctaatgacccaagattactgggaaaacctttaccaacagacgctgcgtgctgctggcaaaacctacatgatcttctttgtcgtagtgattttcctgggctccttttatctaataaacttgatcctggctgtggttgccatggcatatgaagaacagaaccaggcaaacattgaagaagctaaacagaaagaattagaatttcaacagatgttagaccgtcttaaaaaagagcaagaagaagctgaggcaattgcagcggcagcggctgaatatacaagtattaggagaagcagaattatgggcctctcagagagttcttctgaaacatccaaactgagctctaaaagtgctaaagaaagaagaaacagaagaaagaaaaagaatcaaaagaagctctccagtggagaggaaaagggagatgctgagaaattgtcgaaatcagaatcagaggacagcatcagaagaaaaagtttccaccttggtgtcgaagggcataggcgagcacatgaaaagaggttgtctacccccaatcagtcaccactcagcattcgtggctccttgttttctgcaaggcgaagcagcagaacaagtctttttagtttcaaaggcagaggaagagatataggatctgagactgaatttgccgatgatgagcacagcatttttggagacaatgagagcagaaggggctcactgtttgtgccccacagaccccaggagcgacgcagcagtaacatcagccaagccagtaggtccccaccaatgctgccggtgaacgggaaaatgcacagtgctgtggactgcaacggtgtggtctccctggttgatggacgctcagccctcatgctccccaatggacagcttctgccagagggcacgaccaatcaaatacacaagaaaaggcgttgtagttcctatctcctttcagaggatatgctgaatgatcccaacctcagacagagagcaatgagtagagcaagcatattaacaaacactgtggaagaacttgaagagtccagacaaaaatgtccaccttggtggtacagatttgcacacaaattcttgatctggaattgctctccatattggataaaattcaaaaagtgtatctattttattgtaatggatccttttgtagatcttgcaattaccatttgcatagttttaaacacattatttatggctatggaacaccacccaatgactgaggaattcaaaaatgtacttgctataggaaatttggtctttactggaatctttgcagctgaaatggtattaaaactgattgccatggatccatatgagtatttccaagtaggctggaatatttttgacagccttattgtgactttaagtttagtggagctctttctagcagatgtggaaggattgtcagttctgcgatcattcagactgctccgagtcttcaagttggcaaaatcctggccaacattgaacatgctgattaagatcattggtaactcagtaggggctctaggtaacctcaccttagtgttggccatcatcgtcttcatttttgctgtggtcggcatgcagctctttggtaagagctacaaagaatgtgtctgcaagatcaatgatgactgtacgctcccacggtggcacatgaacgacttcttccactccttcctgattgtgttccgcgtgctgtgtggagagtggatagagaccatgtgggactgtatggaggtcgctggtcaagctatgtgccttattgtttacatgatggtcatggtcattggaaacctggtggtcctaaacctatttctggccttattattgagctcatttagttcagacaatcttacagcaattgaagaagaccctgatgcaaacaacctccagattgcagtgactagaattaaaaagggaataaattatgtgaaacaaaccttacgtgaatttattctaaaagcattttccaaaaagccaaagatttccagggagataagacaagcagaagatctgaatactaagaaggaaaactatatttctaaccatacacttgctgaaatgagcaaaggtcacaatttcctcaaggaaaaagataaaatcagtggttttggaagcagcgtggacaaacacttgatggaagacagtgatggtcaatcatttattcacaatcccagcctcacagtgacagtgccaattgcacctggggaatccgatttggaaaatatgaatgctgaggaacttagcagtgattcggatagtgaatacagcaaagtgagattaaaccggtcaagctcctcagagtgcagcacagttgataaccctttgcctggagaaggagaagaagcagaggctgaacctatgaattccgatgagccagaggcctgtttcacagatggttgtgtacggaggttctcatgctgccaagttaacatagagtcagggaaaggaaaaatctggtggaacatcaggaaaacctgctacaagattgttgaacacagttggtttgaaagcttcattgtcctcatgatcctgctcagcagtggtgccctggcttttgaagatatttatattgaaaggaaaaagaccattaagattatcctggagtatgcagacaagatcttcacttacatcttcattctggaaatgcttctaaaatggatagcatatggttataaaacatatttcaccaatgcctggtgttggctggatttcctaattgttgatgtttctttggttactttagtggcaaacactcttggctactcagatcttggccccattaaatcccttcggacactgagagctttaagacctctaagagccttatctagatttgaaggaatgagggtcgttgtgaatgcactcataggagcaattccttccatcatgaatgtgctacttgtgtgtcttatattctggctgatattcagcatcatgggagtaaatttgtttgctggcaagttctatgagtgtattaacaccacagatgggtcacggtttcctgcaagtcaagttccaaatcgttccgaatgttttgcccttatgaatgttagtcaaaatgtgcgatggaaaaacctgaaagtgaactttgataatgtcggacttggttacctatctctgcttcaagttgcaacttttaagggatggacgattattatgtatgcagcagtggattctgttaatgtagacaagcagcccaaatatgaatatagcctctacatgtatatttattttgtcgtctttatcatctttgggtcattcttcactttgaacttgttcattggtgtcatcatagataatttcaaccaacagaaaaagaagcttggaggtcaagacatctttatgacagaagaacagaagaaatactataatgcaatgaaaaagctggggtccaagaagccacaaaagccaattcctcgaccagggaacaaaatccaaggatgtatatttgacctagtgacaaatcaagcctttgatattagtatcatggttcttatctgtctcaacatggtaaccatgatggtagaaaaggagggtcaaagtcaacatatgactgaagttttatattggataaatgtggtttttataatccttttcactggagaatgtgtgctaaaactgatctccctcagacactactacttcactgtaggatggaatatttttgattttgtggttgtgattatctccattgtaggtatgtttctagctgatttgattgaaacgtattttgtgtcccctaccctgttccgagtgatccgtcttgccaggattggccgaatcctacgtctagtcaaaggagcaaaggggatccgcacgctgctctttgctttgatgatgtcccttcctgcgttgtttaacatcggcctcctgctcttcctggtcatgttcatctacgccatctttggaatgtccaactttgcctatgttaaaaaggaagatggaattaatgacatgttcaattttgagacctttggcaacagtatgatttgcctgttccaaattacaacctctgctggctgggatggattgctagcacctattcttaacagtaagccacccgactgtgacccaaaaaaagttcatcctggaagttcagttgaaggagactgtggtaacccatctgttggaatattctactttgttagttatatcatcatatccttcctggttgtggtgaacatgtacattgcagtcatactggagaattttagtgttgccactgaagaaagtactgaacctctgagtgaggatgactttgagatgttctatgaggtttgggagaagtttgatcccgatgcgacccagtttatagagttctctaaactctctgattttgcagctgccctggatcctcctcttctcatagcaaaacccaacaaagtccagctcattgccatggatctgcccatggttagtggtgaccggatccattgtcttgacatcttatttgcttttacaaagcgtgttttgggtgagagtggggagatggattctcttcgttcacagatggaagaaaggttcatgtctgcaaatccttccaaagtgtcctatgaacccatcacaaccacactaaaacggaaacaagaggatgtgtctgctactgtcattcagcgtgcttatagacgttaccgcttaaggcaaaatgtcaaaaatatatcaagtatatacataaaagatggagacagagatgatgatttactcaataaaaaagatatggcttttgataatgttaatgagaactcaagtccagaaaaaacagatgccacttcatccaccacctctccaccttcatatgatagtgtaacaaagccagacaaagagaaatatgaacaagacagaacagaaaaggaagacaaagggaaagacagcaaggaaagcaaaaaatagagcttcatttttgatatattgtttacagcctgtgaaagtgatttatttgtgttaataaaactcttttgaggaagtctatgccaaaatcctttttatcaaaatattctcgaaggcagtgcagtcactaactctgatttcctaagaaaggtgggcagcattagcagatggttatttttgcactgatgattctttaagaatcgtaagagaactctgtaggaattattgattatagcatacaaaagtgattgattcagttttttggtttttaataaatcagaagaccatgtagaaaacttttacatctgccttgtcatcttttcacaggattgtaattagtcttgtttcccatgtaaataaacaaccacg

SEQ ID NO: 367 - protein, 1977 aa, Homo sapiens
  misc_feature: Incyte ID No: 1719478CD1
MAMLPPPGPQSFVHFTKQSLALIEQRIAERKSKEPKEEKKDDDEEAPKPSSDLEAGKQLPFIYGDIPPGMVSEPLEDLDPYYADKKTFIVLNKGKTIFRFNATPALYMLSPFSPLRRISIKILVHSLFSMLIMCTILTNCIFMTMNNPPDWTKNVEYTFTGIYTFESLVKILARGFCVGEFTFLRDPWNWLDFVVIVFAYLTEFVNLGNVSALRTFRVLRALKTISVIPGLKTIVGALIQSVKKLSDVMILTVFCLSVFALIGLQLFMGNLKHKCFRNSLENNETLESIMNTLESEEDFRKYFYYLEGSKDALLCGFSTDSGQCPEGYTCVKIGRNPDYGYTSFDTFSWAFLALFRLMTQDYWENLYQQTLRAAGKTYMIFFVVVIFLGSFYLINLILAVVAMAYEEQNQANIEEAKQKELEFQQMLDRLKKEQEEAEAIAAAAAEYTSIRRSRIMGLSESSSETSKLSSKSAKERRNRRKKKNQKKLSSGEEKGDAEKLSKSESEDSIRRKSFHLGVEGHRRAHEKRLSTPNQSPLSIRGSLFSARRSSRTSLFSFKGRGRDIGSETEFADDEHSIFGDNESRRGSLFVPHRPQERRSSNISQASRSPPMLPVNGKMHSAVDCNGVVSLVDGRSALMLPNGQLLPEGTTNQIHKKRRCSSYLLSEDMLNDPNLRQRAMSRASILTNTVEELEESRQKCPPWWYRFAHKFLIWNCSPYWIKFKKCIYFIVMDPFVDLAITICIVLNTLFMAMEHHPMTEEFKNVLAIGNLVFTGIFAAEMVLKLIAMDPYEYFQVGWNIFDSLIVTLSLVELFLADVEGLSVLRSFRLLRVFKLAKSWPTLNMLIKIIGNSVGALGNLTLVLAIIVFIFAVVGMQLFGKSYKECVCKINDDCTLPRWHMNDFFHSFLIVFRVLCGEWIETMWDCMEVAGQAMCLIVYMMVMVIGNLVVLNLFLALLLSSFSSDNLTAIEEDPDANNLQIAVTRIKKGINYVKQTLREFILKAFSKKPKISREIRQAEDLNTKKENYISNHTLAEMSKGHNFLKEKDKISGFGSSVDKHLMEDSDGQSFIHNPSLTVTVPIAPGESDLENMNAEELSSDSDSEYSKVRLNRSSSSECSTVDNPLPGEGEEAEAEPMNSDEPEACFTDGCVRRFSCCQVNIESGKGKIWWNIRKTCYKIVEHSWFESFIVLMILLSSGALAFEDIYIERKKTIKIILEYADKIFTYIFILEMLLKWIAYGYKTYFTNAWCWLDFLIVDVSLVTLVANTLGYSDLGPIKSLRTLRALRPLRALSRFEGMRVVVNALIGAIPSIMNVLLVCLIFWLIFSIMGVNLFAGKFYECINTTDGSRFPASQVPNRSECFALMNVSQNVRWKNLKVNFDNVGLGYLSLLQVATFKGWTIIMYAAVDSVNVDKQPKYEYSLYMYIYFVVFIIFGSFFTLNLFIGVIIDNFNQQKKKLGGQDIFMTEEQKKYYNAMKKLGSKKPQKPIPRPGNKIQGCIFDLVTNQAFDISIMVLICLNMVTMMVEKEGQSQHMTEVLYWINVVFIILFTGECVLKLISLRHYYFTVGWNIFDFVVVIISIVGMFLADLIETYFVSPTLFRVIRLARIGRILRLVKGAKGIRTLLFALMMSLPALFNIGLLLFLVMFIYAIFGMSNFAYVKKEDGINDMFNFETFGNSMICLFQITTSAGWDGLLAPILNSKPPDCDPKKVHPGSSVEGDCGNPSVGIFYFVSYIIISFLVVVNMYIAVILENFSVATEESTEPLSEDDFEMFYEVWEKFDPDATQFIEFSKLSDFAAALDPPLLIAKPNKVQLIAMDLPMVSGDRIHCLDILFAFTKRVLGESGEMDSLRSQMEERFMSANPSKVSYEPITTTLKRKQEDVSATVIQRAYRRYRLRQNVKNISSIYIKDGDRDDDLLNKKDMAFDNVNENSSPEKTDATSSTTSPPSYDSVTKPDKEKYEQDRTEKEDKGKDSKESKK

SEQ ID NO: 368 - DNA, 653 bp, Homo sapiens
  misc_feature: Incyte ID No: 351157.2
agcggatccgcacggccttctcgccctcgcagctgctgcggctggagctcgccttcgagaagaaccactacgtggtgggcgccgagcggaagcagctggccggcagtctcagcctctccgagacgcaggtccgacgtgttggagtggggctcagcgaccctcagcctagctgctgccctggaggtggatttcagtctctgcgtgccggccggctcccagagttgcgagaggccggctccgcggtctcccagctacctcccggctgacttttcaccttccgctcccctttcctcctagtctcgaccctactacaccaccgtcccctcccaagtcccgggcagtgagaagatgcccggcatggggggcagccggagcctccctttagcagccagagtaggaagggggcttagtgagggagcccagacccaaacttcatccgcagctttcttcggcggaccttaccctctcctccttcagtggcattttggcatctattgtcgtcatatctgtctgctgccccacttaatctacaaatcgctcacgggtcggaggcaggacccgtgcgttttcagatgtactagctgggctgttctaactgcagggaaaaagcttacaaaacaagagttaattttaaaaacgtttcaaagaaagat

SEQ ID NO: 369 - DNA, 2309 bp, Homo sapiens
  misc_feature: Incyte ID No: 088957CB1
acacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttgccttcattagctgctgattttgttgaaagtaaggatgtttgcaaaaactatgctgaggcaaaggatgtcttcctgggcatgtttttgtatgaatatgcaagaaggcatcctgattactctgtcgtgctgctgctgagacttgccaagacatatgaaaccactctagagaagtgctgtgccgctgcagatcctcatgaatgctatgccaaagtgttcgatgaatttaaacctcttgtggaagagcctcagaatttaatcaaacaaaattgtgagctttttgagcagcttggagagtacaaattccagaatgcgctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatctatccgtggtcctgaaccagttatgtgtgttgcatgagaaaacgccagtaagtgacagagtcaccaaatgctgcacagaatccttggtgaacaggcgaccatgcttttcagctctggaagtcgatgaaacatacgttcccaaagagtttaatgctgaaacattcaccttccatgcagatatatgcacactttctgagaaggagagacaaatcaagaaacaaactgcacttgttgagctcgtgaaacacaagcccaaggcaacaaaagagcaactgaaagctgttatggatgatttcgcagcttttgtagagaagtgctgcaaggctgacgataaggagacctgctttgccgaggagggtaaaaaacttgttgctgcaagtcaagctgccttaggcttataacatcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttcttgtgggctaattaaataaatcattaatactcttctaagttatggattataaacattcaaaataatattttgacattatgataattctgaataaaagaacaaaaaccatggtataggtaaaaaaaaaaagagaaaaaaggggaaagaaaaattatgc

SEQ ID NO: 370 - protein, 609 aa, Homo sapiens [sequence omitted]

SEQ ID NO: 371 - DNA, 1620 bp, Homo sapiens
  misc_feature: Incyte ID No: 980446.1
  unsure 1524: a, t, c, g, or other
caagaattgcatatgtcttttatgggccatatatcaatgtctccagctgcagatttattgatagttccaatcctggacttcagatttctctcaatgtcaataatactgaacatgttgtttctattgtaactgattaccataacctgaagacaagattcaattatctgggattcggtggctttgccagtgtggctgatcaaggccaaataacccgatttggtttgggcactcaagcaatagtaaagcctgtaagacatgataggattattttccccttggatttaaatttaatatagcagttggattaattttgtgcattagcttggtgattttaactttccaatggcgtttttacctttcttttagaaaactaatgcgatggatattaatacttgttattgccttgtggtttattgagcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaaccttttttaccttccctatgaaggggaaatatcaccaactaatactaatgtttggaaacngaacttgccctagagatgaaattaaactaattgaaaacatctgctggactctgatggatcgcctaggatatccaaagtttatggactaaatgctgc

SEQ ID NO: 372 - DNA, 1186 bp, Homo sapiens
  misc_feature: Incyte ID No: 198827.1
gcaagcgaaaggagaggaggcggctaattaaatattgagcagaaagtcgcgtggggagagtcacgtgggtctggaggctcaaggaggctgggataaataccgcaaggcactgagcaggcgaaagagcgcgctcggacctccttcccggcggcagctaccgagagtgcggagcgaccagcgtggcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaa

SEQ ID NO: 373 - DNA, 3128 bp, Homo sapiens
  misc_feature: Incyte ID No: 1102297.22
tttggctttattcattttttgtgagagttgaccatcaggtatattggggaagggagagatggaggcaccttcatgagtgcctcccaagggcagtagcctctgcaacttgctgggggttcaggggaagcagggagttcatggggctcctccagcaaagatgagctccagggctgcttggatgtccccaccggtggcctgcagggcccgcaggctcagctcatcgtcctggatgcccatgtcacgtagctgctgcagctggggctgccactggctctgaaggctgggctgcccagaggcctgaagggcatgctgtagggcttggctgaagagatcattggtgatgggcgtccctgactggacaccagaggacattggtgaggtccctgaggaatgaccctgggtgccaggagtcggtgtgtgagagctgctctccggagtgctggccagggccaaggcggtggccagctcactctgggtgatgggccggggcccagcagctccactgtaccccagggaggctgggcgggagctgggagtactgctagagggtgtggacctggtgtttgggtgaaagtcatcctcatcatctgagagcccttcaaacaggaagccacctggcatatcccggtatgagctggagggcatgctccgggaagaggagtcagtcccaggcattggggcactgcctgctacggagtgcagaaccaggacaatggcattgacgagggctgggtgagcaggcaccaacgtatcaagcatattgggatcagcgaagacagagaagaggtccttgtcctggagaaccccaagagcaatagggtcactgctgaggcctggggtggccacaatgatctgatccagagactccttattgctgagcatcttaaagaccgcctccctgtaagaggagctgctgtgcagggcagtgtgcaacacccggaactctctcatggcagccactttgtccacaggttccggtttctgatcaggttcaggccaggactttcgcagaacatggacagtggacccaggttgaatgccatagaagtcaagtgtctggtcatcttttagcttccgaccacagtagatcagatcaatcagctcagggtctggaacagactcctggagtttgccagcaataagctgcttcagaaatgaaatactatagccccctagcgagtattctcccagttctgtctctggcaaccgaagaatagactttggagtaagtggctggtcagccagcttcaccgccaggtgccagtctgagagagacatcctctctctttcgcgctctctctttctccccgtcccgccgagaccgcgtccgccccgcgagcacagagcctcgcctttgccgatccgccgcccgtccacacccgccgccagctcaccatggatgatgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggctggccgggacctgactgactacctcatgaagatcctcaccgagcgcggctacagcttcaccaccacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcatggctttatttgttttttttgttttgttttggttttccttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatgaaaaaa

SEQ ID NO: 374 - DNA, 534 bp, Homo sapiens
  misc_feature: Incyte ID No: 215112.1
aaatgctttcgccaatctcttaaagtagttgagaagctaggtgtgttagtttcccttctgtgatagagaagaaacctgtgttggagagcagtgagcttatgtgtctgtggccatctctgacctgattcacacatgtgcccctcacagacaggcacagacacagggttggcatgcctctagccttacagcctcttggatgaaaggtataagacacattcacatgttggagtgaattaagcacacatccattttgaaatcacagggctggataccacttaaagaatattgatcttgcattgggcaacgcatagcaactgccctacatttccccttttacctagcgtcacaaccaccagtactagaaagcagttaatctgctcaccaaaataacagagagagactttagtggcattttttccacttggtaattgactagactctggctattagctccttttttttccttactatccttttcaaactaataacgtgacttctcataattttaaagtaacttgatgcttacacaaagta

SEQ ID NO: 375 - DNA, 1254 bp, Homo sapiens
  misc_feature: Incyte ID No: 171495.1
accggccctgcttgcctcagccacaaagaatccctggaaatcgccgatggcagcggcgggggatcgcggcgcctgagaactgcttacaccaacacacagcttctagagctggaaaaagaatttcatttcaacaagtacctttgcagaccccgaagggtggagattgcagcgctgctggatttgactgagagacaagtgaaagtgtggtttcagaaccggaggatgaagcacaagaggcagacccagtgcaaggaaaaccaaaacagcgaagggaaatgtaaaagccttgaggactccgagaaagtagaggaggacgaggaagagaagacgctctttgagcaagcccttagcgtctctggggcccttctggagagggaaggctacacttttcagcaaaatgccctctctcagcagcaggctcccaatggacacaatggcgactcccaaagtttcccagtctcgcctttaaccagcaatgagaaaaatctgaaacattttcagcaccagtcacccactgttcccaactgcttgtcaacaatgggccagaactgtggagctggcctaaacaatgacagtcctgaggcccttgaggtcccctctttgcaggactttagcgttttctccacagattcctgcctgcagctttcagatgcagtttcacccagtttgccaggttccctcgacagtcccgtagatatttcagctgacagcttagacttttttacagacacactcaccacaatcgacttgcagcatctgaattactaaaaacattaaagcaaaacaaagcatcaccaaacaaaaactcctttgaccaggtggttttgccttcttttatttgggagtttattttttattttcttcttgacctaccccttccctcctttaagtgttgaggatttctgtttagtgattccctgacccagtttcaaacagagccatcttttacagattattttggagttttagttgttttaaacctaactcaacaaccctttatgtgattcctgagagcagtatgaggcctgcaagaaagtgatcatataattgtatcttcactttctttttatttttgtattacattgggatgcattgtcatgcatattttttgtagaataaattctcctttgctataagtagcttatttttctccccctcttttttcaaggctcataacgggttctttttcttcttttagtctaacttcgtaaataaaattcgtcacaatttatcttcttttttcaattttaatac

SEQ ID NO: 376 - DNA, 1962 bp, Homo sapiens
  misc_feature: Incyte ID No: 242010.43
agaacgggcaagggggagcgcaacgtgctcatctttgacctggggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgcctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccagggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggcggacaagaagaaggttctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccctaccattgaggaggtggattaggggcctttgttctttagtatgtttgtctttgaggtggactgttgggactcaaggactttgctgctgttttcctatgtcatttctgcttcagctctttgctgcttcacttctttgtaaagttaagttgtaacctgatggtaattagctggcttcattatttttgtagtacaaccgatatgttcattagaattctttgcatttaatgttgatactgtaagggtgtttcgttccctttaaatgaatcaacactgccaccttctgtacgagtttgtttgtttttttttttttttttgcttggcgaaaacactacaaaggctgggaatgtatgtttttataatttgtttatttaaatatgaaaaataaaatgttaaactttttcttgtctgttaatatgtgaagataatggatatttgcggagggatagtgtctgaataccaactgatctcttatcagtcgtgaaaagtacagtactgactgaagagttatacgtgtaggacttagagctacacatatttttattgggcttaacttgtgggccttaagagaaattgcaggtgcccgtcttgattagagtggggcttgtttcagggtaa

SEQ ID NO: 377 - DNA, 2919 bp, Homo sapiens
  misc_feature: Incyte ID No: 5834958CB1
ttggctttggccctcgtcatcctgcccacccagcggggcttcccaacccaccacacagccatggacgggaaggtggcagtgcaagagtatgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggagccttcttcatcccctacttcatcttcttctttgtctgcggcatcccggtgttcttcctggaggtggcgttgggccaatacaccagccaagggagtgtcacagcctggaggaagatctgccccctcttccagggcattggtctggcatctgtggtcatcgagtcatatttgaatgtctactacatcatcatccttgcctgggctctcttctacctgttcagctccttcacctctgagctgccctggacgacctgcaacaacttttggaacacagagcattgcacggactttctgaaccactcaggagccggcacagtgaccccatttgagaattttacctcacctgtcatggaattctgggagagacgagttctgggcatcacctcgggcatccatgacctgggctccctgcgctgggagctggccctgtgcctcctgctcgcctgggtcatctgctatttctgcatctggaagggggtcaagtccacaggcaaggtggtttatttcacagccacgtttccgtacctgatgcttgtcattttgctgatcagaggtgtcacccttcccggagcctaccagggcatcatctactacttgaagccagatttgttccgcctcaaggaccctcaggtgtggatggatgcgggcacccagatcttcttctcctttgccatctgccaggggtgcctgacagccctgggcagctacaacaagtatcacaacaactgctacaaggactgcatcgccctctgcttcctgaacagtgccaccagctttgtggctgggtttgttgtcttctccatcctgggcttcatgtcccaagagcaaggggtgcccatttctgaagtggccgagtcaggtcctgggctggccttcatcgccttccccaaggctgtgactatgatgcccttatcccagctgtggtcctgcctgttctttatcatgctcatattcctagggctggacagccagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgagggcgggatgtacatcttccagctgtttgactactatgcttccagtggcatatgcctgctgttcctgtcattgtttgaagtggtctgcataagctgggtgtatggggcggaccgtttctatgacaacattgaggacatgattggctaccggccatggcccctggtgaagatctcctggctcttcctgacccctggactttgcctggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcatactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagccttcgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccaaaaaaaaaaaaaaaagaaaaaaaaaaaaaaa

SEQ ID NO: 378 - protein, 614 aa, Homo sapiens
  misc_feature: Incyte ID No: 5834958CD1
MDGKVAVQEYGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSATSFVAGFVVFSILGFMSQEQGVPISEVAESGPGLAFIAFPKAVTMMPLSQLWSCLFFIMLIFLGLDSQFVCVECLVTASIDMFPRQLRKSGRRELLILTIAVMCYLIGLFLVTEGGMYIFQLFDYYASSGICLLFLSLFEVVCISWVYGADRFYDNIEDMIGYRPWPLVKISWLFLTPGLCLATFLFSLSKYTPLKYNNVYVYPPWGYSIGWFLALSSMVCVPLFVVITLLKTRGPFRKRLRQLITPDSSLPQPKQHPCLDGSAGRNFGPSPTREGLIAGEKETHL

SEQ ID NO: 379 - DNA, 2712 bp, Homo sapiens
  misc_feature: Incyte ID No: 335648.1c
  unsure 236-590: a, t, c, g, or other
tttatgcccttggcaaaataaaagatcttatcaatataaatgtttcttagaaaatgtatgaaaagataatatatattaataaatcaatattaacattacagcaaaagtaataatgattatataacaatgacaagtgaagatatttctggcccttacacagtagtatttctggaaggtctctgattcctgcttgctctagtacaggcgtgctctcactttaagaaagcctgatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgatgcacacaaatctaaatttggcaagtcgatcaattaaaggatatttatttgcatcacaaaataattctttactccccccaaaaatcaataaaaagttcaaatagcaacttttcctaatgtgtttaaaatgtaatcaccaaatacatgtgtccccaacttctttccagttataattctattgtgtaaagtgaggtatacctgaagtgaggcaataagagagttgagcttcagacctgcctggagagagcgtgttctttcttagagtctgaggaaatggttgggggcacaaattctctcaatctttttcttttccctcatcctgagctcttattttcttgtctcaactgctttctggtaaactttgttcacctggtactttcaagaaaaaaagaaggaaatcttacgagagggaggcagattaatgaattagtgagtcactctagcagcgcagagcaagggagaatctgcgatgtgaatgaggaggatctgagtgtgggtgtggttgtacttggggaaaagcaggaacaatcttgaacccttgacatggtgcatttgaggcccctctcccagtagggccacctgagtccctgaggagccgcaaggcctagtccagccttccctagatgggacacatcctcaggagaatggatgcaggcctatttatcacactcctcctggctgccttcagcacaatggtagtgctgctcacagaactcctggatccggctgcacgcctccagcatcatcacctcggggactgtgatgaccactcggatgaaattcgggtactcaaagcacgttgctgggaggcagtggacagactgctcagcaactaaccgctccgtgaactccacatcgttctcaaattctgggaaatgttccatctcaattccaaccatgaggtacatagccccagaagggcggactggccggagtccagggatggcagccaacgccccataacagagatcagcattggacttgaggaagctcagagtgttgtggtaaaactctcccggggtgcgacataggatgcttttcagagctccctggacaatggtacagggtcccaaaatgcgctgactcagcttcaccagcccatctcggatctcattgccaaaaatgtctcttcggtcatgaatgaggatccagcccaacctccagccaggaaccagccagcgcttggccagccctccacaggacaggatggggacatcggtgctgagggtggccagtggttcatatttgcaatccgaaaacaccatgtctccatagatctcatcagctaagatggggacacactgccgtgcagccactgccagaatcttctgaagatgacgtttgctgaacactgacccacaggggtttgatggattattgacaatgagacaagctgtcttttcatcaattagatattccagttgtttcaggtcaatttcccaagatttctctggcaacaaattgtagagtttgacctcaattcccatagactcagccagagtcttgtagagagagaaaccaggtcttggaaccaggatgttttgccctgggttggccaacacagctaaacaaaggtcaatagcttggctgcagccacttgtcagaatgacgtccttagcttctaggggtgcctcaggacagtggtaataagaagcaatctcctcccgactggataggaagccgatggatggggcatagccattatatttgcccgagtccagggcatctttcattgcctgggtaacttcagggtctgtaggcaggtttccaaacacagtagggtccccaatggacagggaaatcatggttttgtttggatttggtttcaccttcatgttgtccacaatggctcggatggggttgaaagttttcttggccatgtctgagggcctcacagaccacctggcctttctgcctttcatttttcccggcacagagcttctcccaccaacgttgacatgcacgtccagaattgaggagaggttgcctttgctgctcatctgaatcatgtatgggtccatcactagcgaagccttccaagtaaaggagaaagcagcctccaagaagccaaccccgaaagctcccttagctcttctttgacaggttacaggggcaat

SEQ ID NO: 380 - DNA, 3074 bp, Homo sapiens
  misc_feature: Incyte ID No: 333840.1
  unsure 2358-2447, 2522-2843: a, t, c, g, or other
tagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcggtgcttgaatgtcattttgtggttgggattctgggctgtgcagctgaatgtctgtctgtcacgaatctaccttgctgctcattttcctcatcaagttgttgctggagtcctgtcaggcattgctgttacagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgttcaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcgtcattttgaggccagaggtgctgtcagctcaggtggtcctcttttacaatcctaatcatattgggtaatgtttttgaaaagctaatgaagctattgagaaagacctgttgctagaagttgggttgttctggattttcccctgaagacttacttattcttccgtcacatatacaaaagcaagacttccaggtagggccagctcacaagcccaggctggagatcctaactgagaattttctacctgtgttcattcttaccgagaaaaggagaaaggagctctgaatctgataggaaaagaaggctgcctaaggaggagtttttagtatgtggcgtatcatgcaagtgctatgccaagccatgtctaaatggctttaattatatagtaatgcactctcagtaatgggggaccagcttaagtataattaatagatggttagtggggtaattctgcttctagtattttttttactgtgcatacatgttcatcgtatttccttggatttctgaatggctgcagtgacccagatattgcactaggtcaaaacattcaggtatagctgacatctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccacagcgtcccgcgtagctggcatacaggtgcaagccactatgtccagctagccaactcctccttgcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattact

SEQ ID NO: 381 - DNA, 2905 bp, Homo sapiens
  misc_feature: Incyte ID No: 480885.2
gaggaggaagatcaggatgaggaggaagaagaggaaaaaagagaaaaagaagaaatatcacagaaaaaaaaattcttcgttgtctagactgggctttttttcccccctaaaaaatagcatattggagaattgggagaagtctctttggtttggaaaaaaaaaaaaggaatcttcagcctagatcactttcttatccggactgggatattaaatatacgacacatccaggagtttattggagcgcagactgatggcgcaaaggtacgatgagctgccccattacggcgggatggacggagtaggggttcccgcttccatgtacggagaccctcacgcgccgcggccgatccccccggttcaccacctgaaccacgggccgtcgctccacgccacacagcactacggcgcgcacgccccgcaccccaatgtcatgccggccagtatgggatccgctgtcaacgacgccttgaagcgggacaaggacgcgatctatgggcacccgttgtttcctctgttagctctggtctttgagaagtgcgagctggcgacctgcactccccgggaacctggagtggctggcggagacgtctgctcctccgactccttcaacgaggacatcgcggtcttcgccaagcaggttcgcgccgaaaagccacttttttcctcaaatccagagctggacaatttgatgatacaagcaatacaagtactaaggtttcatcttttggagttagaaaaggtccacgaactgtgcgataacttctgccaccgatacattagctgtttgaaggggaaaatgcccatcgacctcgtcattgatgaaagagacggcagctccaagtcagatcatgaagaactttcaggctcctccacaaatctcgctgaccataacccttcttcttggcgagaccacgatgatgcaacctcaacccactcagcaggcaccccagggccctccagtgggggccatgcttcccagagcggagacaacagcagtgagcaaggggatggtttagacaacagtgtagcttcacctggtacaggtgacgatgatgatccggataaggacaaaaaacgccagaagaaaagaggcattttccccaaagtagcaacaaatatcatgagagcatggctcttccagcatctcacacatccgtacccttccgaagagcagaagaaacagttagcgcaagacacaggacttacaattctccaagtaaacaactggtttattaatgccagaagaagaatagtacagcccatgattgaccagtcaaatcgagcagtgagccaaggagcagcatatagtccagagggtcagcccatggggagctttgtgttggatggtcagcaacacatggggatccggcctgcaggacctatgagtggaatgggcatgaatatgggcatggatgggcaatggcactacatgtaaccttcatcatgtaaagcaatcgcaaagcaagggggaagtttgcagagcatgccaggggactacgtttctcagggtggtcctatgggaatgagtatggcacagccaagttacactcctccccagatgaccccacaccctactcaattaagacatggacccccaatgcattcatatttgccaagccatccccaccacccagccatgatgatgcacggaggaccccctacccaccctggaatgactatgtcagcacagagccccacaatgttaaattctgtagatcccaatgttggcggacaggttatggacattcatgcccaatagtataagggaactcaagggaaaaggaaacacacgcaaaaactattttaagactttctgaactttgaccagatgttgacacttaatatgaaattccagacagctgtgattattttttacttttgtcatttttcatcaagcaacagaggaccaatgcaacaagaacacaaatgtgaaatcatgggctgactgagacaattctgtccatgtaaagatcctctggaaaaagactccgagagttataactactgtagtataaatataggaactaagttaaacttgtacatttctgttgatcacgccgttatgttgcctcaaatagttttagaagagaaaaaaaaatatatccttgttttccacactatgtgtgttgttcccaaaagaatgactgttttggttcatcagtgaattcaccatccaggagagactgtggtatatattttaaacctgttgggccaatgagaaaagaaccacactggagatcatgatgaacttttggctgaacctcatcactcgaactccagcttcaagaatgtgttttcatgcccggcctttgttcctccataaatgtgtcctttagtttcaaacagatctttatagttcgtgcttcataagccaattcttattattatttttgggggactcttcttcaaagagcttgccaatgaagatttaaagacagagcaggagcttcttccaggagttctgagccttggttgtggacaaaacaatcttaagttgggcagctttcctcaacacaaaaaaaagttattaatggtcattgaaccataactaggactttatcagaaactcaaagcttgggggataaaaaggagcaagagaatactgtaacaaacttcgtacagagttcggtctattaattgtttcatgttagatattctatgtgtttacctcaattgaaaaaaaaaagaatgtttttgctagtatcagatctgctgtggaattggtattgtatgtccatgaattcttcttttctcagcacgtgttcctcactagaagaaaatgctgttacctttaagctttgtcaaatttacattaaaatacttgtatgaggactgtgacgttatgttaaaaaaaaaaggtgttaagtcacaaaaagcggtaataaatatttcatttttgattttt

SEQ ID NO: 382 - DNA, 915 bp, Homo sapiens
  misc_feature: Incyte ID No: 998106.8c
tttaatcatttttaagtatttaatcattttttaaaaatctgtgatgctttacctgggcatgtctaggcaggtcctcctttgctaggacgtgcccttttctgtcccggaatactctaaacttggcattttggcagcgtgaagttttcccgttgtgactttctccttgttcccttttctcctccttctttgcagacaatgagtagccactgctgtttgccctgggcccatcaatgagaagatctgctcttagagccctgctttcctgctgaaggccctgaaatcacctgtgttccaggccacctgctaacaataaataatgctgccctgatgtggggaattagctcaagtggtagagcgcttgcttagcacgcaagaggtagtgggatcgatgcccacattctccaagctttattatttagacatcgtgtctccaaacactcaggtctccaaacccaagttagtgtctgagaacaggatgctgctttggttcaagacgtaggagcagcaataatagagggctggtgatggctccctcttggcattcagtatagtgtagatctaccatgtaattaattctctgtttctttgaggagctgtgaaaccaagggacatatacaactgctcttttctccctgtttctacctgcagctttgtcctaaatgtgagacaattatgaaaagtgcagcgcagagccacttgggtaaatacagccccggctttctgctcaggggacagagtttgaggcactgcagaggaaccggccaaagtatgagacccatatattgagagtaacagagtgtaaagttcaaaaaaatcaaaatatttaaagatttatcatgggtcttgatgacatgatggaatctctctactctctggacttattatgtgtggtaataaatttactttttaaaagcc

SEQ ID NO: 383 - DNA, 933 bp, Homo sapiens
  misc_feature: Incyte ID No: 400701.4
  unsure 850: a, t, c, g, or other
cccgggccctagactgcgcgccgccaccgcccgctccctggcccatgccagcgtctggggctgcctggccaccgtgtccacccacaagaagatccaaggactgccatttgggaactgcctgcccgtcagtgatggccccttcaacaatagcactgggattcctttcttctacatgacagccaaggaccccgtggtggctgatctgatgaagaaccccatggcctcgctgatgctgccagaatcagaaggggagttctgcagaaaaaacatcgttgatccggaagatccccgatgtgtccagttaacgctcactggccagatgatcgcagtgtctccagaagaagtagaatttgccaagcaagccatgttttcaaggcacccagggatgaggaagtggcctcgtcaatatgaatggttctttatgaagatgaggatagaacatatctggcttcagaaatggtatggaggcgcatccagtatttcaagggaggaatatttcaaagcagttcccagaaaggcctgatggagtgagaagaaagtccttggtgtttgcacttaaataaaaaccttttcagtgatgcagccagacagctattgaccactgtctctttgttgaagggttcatagcagccctgccatccctgcagcagaatgagagagggtgaacagggaactctatgctagatttgagattaaagtggtcatttgcagatctccaactcacacagatacttcacgtagatagtctttattccattgtattcaatccagactcatcgattcagaaatcatataatagctggtggtcaaaatgacatgttgagatcattgttgtttcattgtttaaggnaaaaaaaaaatgcctgtacctacaatgtgattgctttgtattgtgagagtatcttgttgcttgctctgccaaatgcagtcttg

SEQ ID NO: 384 - DNA, 796 bp, Homo sapiens
  misc_feature: Incyte ID No: 1100320.4
ggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgt

SEQ ID NO: 385 - DNA, 864 bp, Homo sapiens
  misc_feature: Incyte ID No: 246727.11
  unsure 847, 856: a, t, c, g, or other
gagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttcccttctaaccattcttttatgtcatcaagagttgcatcagttgggaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggtttggatacatccctatcctttttagcaatcagtttgaaaatctgtagaaacttagacaaaattagtagaaagtaattttaaaaattgtgttattaaattagtttctacttgatcatttgttatgccctagatgtgatgtctganattttctgnattatact

SEQ ID NO: 386 - DNA, 2742 bp, Homo sapiens
  misc_feature: Incyte ID No: 246727.17
  unsure 1841-2010: a, t, c, g, or other
ctgccgggacggtccccatcttcttggagcgctttaggctggccggcggcgctgggaggtggagtcgttgctgttgctgtttgtgagcctgtggcgcggcttctgtgggccggaaccttaaagatagccgcaatggctgaaaatggtgataatgaaaagatggctgccctggaggccaaaatctgtcatcaaattgagtattattttggcgacttcaatttgccacgggacaagtttctaaaggaacagataaaactggatgaaggctgggtacctttggagataatgataaaattcaacaggttgaaccgtctaacaacagactttaatgtaattgtggaagcattgagcaaatccaaggcagaactcatggaaatcagtgaagataaaactaaaatcagaaggtctccaagcaaacccctacctgaagtgactgatgagtataaaaatgatgtaaaaaacagatctgtttatattaaaggcttcccaactgatgcaactcttgatgacataaaagaatggttagaagataaaggtcaagtactaaatattcagatgagaagaacattgcataaagcatttaagggatcaatttttgttgtgtttgatagcattgaatctgctaagaaatttgtagagacccctggccagaagtacaaagaaacagacctgctaatacttttcaaggacgattactttgccaaaaaaaatgaagaaagaaaacaaaataaagtggaagctaaattaagagctaaacaggagcaagaagcaaaacaaaagttagaagaagatgctgaaatgaaatctctagaagaaaagattggatgcttgctgaaattttcgggtgatttagatgatcagacctgtagagaagatttacacatacttttctcaaatcatggtgaaataaaatggatagacttcgtcagaggagcaaaagaggggataattctatttaaagaaaaagccaaggaagcattgggtaaagccaaagatgcaaataatggtaacctacaattaaggaacaaagaagtgacttgggaagtactagaaggagaggtggaaaaagaagcactgaagaaaataatagaagaccaacaagaatccctaaacaaatggaagtcaaaaggtcgtagatttaaaggaaaaggaaagggtaataaagctgcccagcctgggtctggtaaaggaaaagtacagtttcagggcaagaaaacgaaatttgctagtgatgatgaacatgatgaacatgatgaaaatggtgcaactggacctgtgaaaagagcaagagaagaaacagacaaagaagaacctgcatccaaacaacagaaaacagaaaatggtgctggagaccagtagtttagtaaaccaattttttattcattttaaataggttttaaacgacttttgtttgcggggcttttaaaaggaaaaccgaattaggtccacttcaatgtccacctgtgagaaaggaaaaatttttttgttgtttaacttgtctttttgttatgcaaatgagatttctttgaatgtattgttctgtttgtgttatttcagatgattcaaatatcaaaaggaagattcttccattaaattgcctttgtaatatgagaatgtattagtacaaactaactaataaaatatatactatatgaaaagagcaaaaacagtttcttgattttgtttcttctttttgtacccaaagcatttaggaaagaactagaatattagctattgacgatgggcctttcccacaggccattaatggtgtctcctaggctggctttgtatatttacacaggaaagttggtaacactagaaataattacttgtcacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagaaagcttttcaataccgaatgtagaccagccaaaatcaagagacttactgatttctttttgtgaaacttgtatgatgctggcaggtcatatcgaagttctgctataatatctatcttgattttccattctgcagctttcttttgaacatgttctctagttgaggatttgtgtaaggaatatactgctgttcttgccatttccaaagcagtctttagaaaagccatatctgtccctttattatttttggtcccaaagggaggattcataattactgtatcgaatgacttggacattctgttagataataagcacacatcacattgaaccatgtcaatatttgttaactcaaactcttctgcattcctattaaatatttccaatgcgtcttcatctatgtcaaatccaacacacaaccctgctcctaacattgcagttccgatgctaagtactccacaaccacatcctagatctgcaacgactttattttcaatgtcatcataagtgttatggattgtatagagcatacatgctgcaatgtgcggcctggtaggatactgttccagaagtagcttgggcttttcaaatccatccacttgttgcaggcgactctctagttccttaagccttactttcttcattttgttttaaagtatggactcgtagggtttgaaggcacaggatctctggaggcgacccgcacctcggccggtgccggaagcgccaggcc

SEQ ID NO: 387 - DNA, 742 bp, Homo sapiens
  misc_feature: Incyte ID No: 1102322.12c
cgcgatctagaaccttaaataaaactatttaagacattgcattttccacttacaatacagtgtttataaagtgcaatgttatttccttcccctgtgcatatgttccatattcaagtattgagaatgcccagtaacttactatagcagcttaactttttaaaactgccacagaatttgctacgaatttaggtccttcaaatgttttaaatgtgtggaacaatgctacatctacacttggttggcttaatcaacctcttcaatggtgggccctgaggaagcaccaccagagggaggagctccaccaccaggaaatcccccaggcattcctcctggcatgcctcctgcactctggtacagcttggtgatgatagggttgcaaactttctccagctctttctgttgatgttcaaattcttccttctcagcagtctgaggaagagaaaaaggaattactgcaagttcttttaatgttaataacccttctttctccctgacgcaatctgatactaaaagtctggcgcaaactcttacaagagggccactaccaacattaaaatagggccttattcttccttaacatcttgggtcactcagacatccaaggaaggtagttgccaacaccttgaattctggtggaaaccgcgaatgttttggaccattcatcattgtgaccctatactgaaatccagctcaagcttggtttaccatccccttcccctccattgagtgggggaggatattt

SEQ ID NO: 388 - DNA, 1161 bp, Homo sapiens
  misc_feature: Incyte ID No: 1102322.18
attgaagtcacttttgacattgatgccaatggtatcctcaatgtctctgctgtggacaagagtacgggaaaagagaacaagattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaatttgaacatcaacagaaagagctggagaaagtttgcaaccccatcatcaccaagctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcagactgccgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaaataaaactatttaaaattggcaccatacaattgctttgagtctttaaataatctcccaggccagctggtgggaga

SEQ ID NO: 389 - DNA, 1432 bp, Homo sapiens
  misc_feature: Incyte ID No: 2070610CB1
tatagtccatatagggatttggccctcgagcatgaattcggcacgaggattcttgggcatttgctattaacttccttccaaaatgtcaccattcctgtatctggttctcttggtacttgggcttcatgctacaatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaaaacctcaagccaaacaccatcatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttttttgttccaaagttttccatttctgccacatatgaccttggagccacacttttgaagatgggcattcagcatgcctattctgaaaatgctgatttttctggactcacagaggacaatggtctgaaactttccaatgctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaaggccattggctaattgcacgtgtgtattgcaatgggaaataaataaataatatagcctggtgtgaaaaaaaacgagaaaaaaaaaaaaaaa

SEQ ID NO: 390 - protein, 415 aa, Homo sapiens
  misc_feature: Incyte ID No: 2070610CD1
MSPFLYLVLLVLGLHATIHCASPEGKVTACHSSQPNATLYKMSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQNLKPNTIMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDFFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 391 - DNA, 1215 bp, Homo sapiens
  misc_feature: Incyte ID No: 336733.3
ctttctccctcttgagtccttctgagatgatggctctgggcgcacgggaataagtaccagaccattgacaactaccagccgtacccgtgcgcagaggacgaggagtgcggcactgatgagtactgcgctagtcccacccgcggaggggacgcaggcgtgcaaatctgtctcgcctgcaggaagcgccgaaaacgctgcatgcgtcacgctatgtgctgccccgggaattactgcaaaaatggaatatgtgtgtcttctgatcaaaatcatttccgaggagaaattgaggaaaccatcactgaaagctttggtaatgatcatagcaccttggatgggtattccagaagaaccaccttgtcttcaaaaatgtatcacaccaaaggacaagaaggttctgtttgtctccggtcatcagactgtgcctcaggattgtgttgtgctagacacttctggtccaagatctgtaaacctgtcctgaaagaaggtcaagtgtgtaccaagcataggagaaaaggctctcatggactagaaatattccagcgttgttactgtggagaaggtctgtcttgccggatacagaaagatcaccatcaagccagtaattcttctaggcttcacacttgtcagagacactaaaccagctatccaaatgcagtgaactccttttatataatagatgctatgaaaaccttttatgaccttcatcaactcaatcctaaggatatacaagttctgtggtttcagttaagcattccaataacaccttccaaaaacctggagtgtaagagctttgtttctttatggaactcccctgtgattgcagtaaattactgtattgtaaattctcagtgtggcacttacctgtaaatgcaatgaaacttttaattatttttctaaaggtgctgcactgcctatttttcctcttgttatgtaaatttttgtacacattgattgttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttgaaataaaatttaacatttaatatcaaaaaa

SEQ ID NO: 392 - DNA, 975 bp, Homo sapiens
  misc_feature: Incyte ID No: 1326902.13
  unsure 174: a, t, c, g, or other
aaagaaatgtatttgaagttctttttctttcccccatagggtagaagagcagaggatggctctgtcattgattatgaactgattgaccaagatgctcgggatctctatgacgctggagtgaagaggaaaggaactgatgttcccaagtggatcagcatcatgaccgagcggacntgccccacctccagaaagtatttgataggtacaagagttacagcccttatgacatgttggaaagcatcaggaaagaggttaaaggagacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagtcttggcgaataacagtcgcccttagtgtcttgctggatataataggacagggactggccgtactttctcttgaattcagacctaattttcaacatgtccacttcactgcgggagaccatgattctgatcaggaccttatctcgctgtcccttgcccttcatggagtcatacagccgatcagcaaaatacaggggcttgttctgaatgcgctgaaccaggttcaggaaagcattttccaggtctcctttaacctcttgcctgatgctttccaacatgtcataagggctgtaactcttgtacctatcaaatactttctggaggtggggcacgctccgctcggtcatgatgctgatccactaggggaacatcaggtcctttcctcttcactccagcgt

SEQ ID NO: 393 - DNA, 1660 bp, Homo sapiens
  misc_feature: Incyte ID No: 1326902.6
ggggacgctctcagctctcggcgcacggcccagggtgaaaatgtttgccattaaactcacatgaagtaggaaatatttatatggatacaaaaggcacctgcatgggataatgtcaaatttcatagatactgctttgtgcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacattttgaccaaccgcagcaatgcacagagacaggatattgccttcgcctaccagagaaggaccaaaaaggaacttgcatcagcactgaagtcagccttatctggccacctggagacgttgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttggccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcattacccccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaacacgtactttgtggccctgctttcaactgaattgtttgaaaattaaacgtgcttggggttcagctggtgaggctgtccctgtaggaagaaagctctgggactgagctgtacagtatggttgcccctatccaagtgtcgctatttaagttaaatttaaatgaaataaaataaaataaaatcagttcctgagtc

SEQ ID NO: 394 - DNA, 773 bp, Homo sapiens
  misc_feature: Incyte ID No: 013521.16
gcgagcgctgcgaggtggcggcctgagcaatggaagagttaatagttgaacttcgtctctttcttgaactcctggaccatgaatatctaacctcaactgtcagggagaaaaaggcagtgataaccaacattctgctaagaatacagtcatccaaaggttttgatgtgaaggaccatgctcagaagcaggagaccgctaacagcctgccagcccctcctcagatgcccctgccggagatccctcagccctggctgcctcctgacagtgggcctccaccattgccaacatcctccctcccagaaggttattatgaggaagctgtgccgctgagccccggaaaagctccggaatacatcacatcaaattatgattccgatgcgatgagcagctcttatgagtcgtatgatgaagaggaggaggatgggaaggggaagaaaacccggcaccagtggccctccgaggaggcctccatggacctggtcaaggacgccaaaatctgcgccttcctgctgcggaagaagcggttcggccagtggaccaagttgctctgcgtcatcaaagacaccaaactgctgtgctataaaagttccaaggaccagcagcctcagatggaactgccactccaaggctgtaacattacgtacatcccgaaagacagcaaaaagaagaagcacgagctgaagattactcagcagggcacggacccgcttgttctcgccgtccagagcaaggaacagggccgagcagtggctgaaggtgatcaaagaagccta

SEQ ID NO: 395 - DNA, 1321 bp, Homo sapiens
  misc_feature: Incyte ID No: 985369.1
taccctctgcctttttaagatgatgtatttatttaatttttgccatcattggtgcttcaccttcctgcgaaggaaattccagagcctgtatttaagctacctaggcttttacactccctttattgcctttccaaatagtatctcatttggtgtactctagtgtcctatacctcttggaaacgaaagagggcccaacctacaactaagaagggacaaaccttgaactaagtaagaccttacacacccagaaagaacactgggccctccttcttcagggacaatgcagtagccacttggcttgtggaatttactgaaggctatttcctgtaacttgctagttaacttagttttgtatttcagggcagaggtgcgctctgtaatgttgggcctttgacttcacagtactggagagctgttcacacagatgtttagacctttctctctctctcttttcttctttctcaacaactctttcacagaggcagtcattttgaaaggttgaaatatttggcctttaccaaagagctttttttttccttaagcaaaatcctttcagaaagaaacaaatggggaagggcagattaagaatgcatatgtcccaatccacttctataggagtttaatcatattcacatgagtaaaatgatggaagaactctttaaggtaatcctttgggataaaggatcctgggaagttctctcaggtaaagaaagcttacagcagatttgtaatatatgtctggagagctatttataagaaatttaagaggattgttttgttttcctttattaaagatttaagcctttttactttgcaaaaagaaaactacaaaagttttatagatataactttgctaattttttaaacttttctgaaacgattagctgtagccaaattatgtggttacgttttgctacattagaatttgaaaatgcaatatgtgtggtaaatctactgtttgaaatttataatggtctctgatatgattcgaattttggtaacttttgaaagttattttccccctttagtcatggatttctatttgttttttaatgttaatttttctagaaagcatctgaattgactaggcttttcctatataaaaaactcaaaacttgttaactctgtactttaataaaatttaaaattaaaactgtgttgtttttttctcttctgctagatacatatataattaaagtactcaagttagttgttttgcagagatgttgccttcagatgttaatcaggtctctcaagtttcatggagtctatgctgatcctttaattgacaaataaaagatatatatctgtggtgtgcaac

SEQ ID NO: 396 - DNA, 1275 bp, Homo sapiens
  misc_feature: Incyte ID No: 002455.1
  unsure 525: a, t, c, g, or other
gcggccgccagcttgcaaagccgaagtctggccgcgctcttcgactcgctgcgccacgtccccgggggtgccgagccggcggggggtgaggtggctgcgccggcggccgggctaggaggtgcgggcactgggggcgcgggaggggacgtggcaggccccgcgggggccacggcgatcccaggggccaggaaggtcccgctgcgggcacgcaatctgccctccgtccttcttcacggagccgtcccgggcaggcggggggcgggtgtggccccgtcggggccggacgtgagccttgggcgacctggagaagggcgcggaggccgtggagttctttgagcctgctggggcccgactacggcgccggcacggaggcggcagtcttgcttgccgccgagcctctcgacgtgtttcccgccggagcctccgtactgcggggacccccggagctggagcccggcctctttgagccgccgccggcagtggtgggaaacctattgtaccccgagccctggagcgtcccggtgnacctccccgaccaaaaagagccccctgactgccccccgcggcggcttgaccttgaacgagcccttgagccccctgtaccccgccgctgcggattctcccggcggggaggacgggccgggccatttggcctctttcgcccccttctttccagactgcgccctgcccccgacgccgccgccccatcaggtgtcctacgattacagcgcgggctacagccgcaccgcctattccagcctttggagatccgacggggtttgggaaggggcgccgggggaggagggggcgcaccgggactgacttcgaggcacgcttcccttcattagagacggctgtggagagcgccgcgcctccgtgggtttctcctaaatctgaagaacgatgggaaatgcacgtggagatgaaaccagatttttaaaaattcaattaataaaagcaacttcagaaaaaagagatgaagacgagttggggattgtttaatcacaacctcaagtgttaaaacaaaaacaaacaaacacgtttgtaggttcttactggaccagaggagtcaagaaaccaagatggtttggggtatggggtggggacggcaaaaggggtaagagctggcttctgtagccacctgtcccttctatttttcagcgaaggtcagtgtatttagtgtaattaccccttctaaacagtgtcctagtccctcccttccctctccttgagtgcattttgaattaaagcctatattgaaaaaaaaaaaaaagg

SEQ ID NO: 397 - DNA, 792 bp, Homo sapiens
  misc_feature: Incyte ID No: 372647.1
accacgtctggcacaaaaaaaatgtatttcttaaaaaggctctaataaaaaacatttgaaagccactgttctaggtgataatgattgtaagatctttgtgtatagttcttgctagctcagtcttattaatagtttcattgagagagaattcaacaggtatttgtttgtaagtactaacaaaaaattgtacattcaatacttatcaaacaaaagttacatgatcttattcttccactattaaatttttattttatttttaaattttgattttttggcatttcacctgcaagtctttttgtcttattagagtcacactatgtgatggtattttttctttatccacaatctcccctgactcccctgttactattatggaataatgtaaagttaagaattaattatgattacagtagttatgggtaattaggtactatgaatcaaatcttagaaatcactttcattattgtaatagtgcctcagaaaacaatttttcctctttgactttttaaattgttaatactatcataaatggcatttatgtattcatttaccaaatattgatcaaaaactactttgtgtctaccatcagaatttaaaagacaccttcctagatcatagagaaggcttactgacatggcacatacagaatggtaaacagatagctatattacacaatgagataagtgcttcaataacaatatagagctgtaagggagtgaattgaagagatactcccctattcttaaatgttcagtgaaattcctttgtcccaaagcgctagttaaacgaagc

SEQ ID NO: 398 - DNA, 1293 bp, Homo sapiens
  misc_feature: Incyte ID No: 208075.1
  unsure 540-668: a, t, c, g, or other
gaagttttactatgtttaataatttagtgaaatttgggctatgtgtttattgattcagctcaatccagaggaaaattttaaaggcttacagccttaggattataggatactatataatacttttggtacagagatagaattaaataacataaaaatcaaaaatttattaggctaaaattttgagggagaagtggtatgaaaatacaaattcaaggagtaaaaggaaaagtggggcattccttgctactaaaaattgccttgttccaggtaagactgatcataaaaaaatggccctgttcataaaatttttaaaaagatcatagtatctatcaaataacttatattaagaacctcctgggctaaatttaaaaagtaatacaacagttttatttaaacatgtagtgtctacggtatgccagcactttgcagctatttataatgagaaattttagatgtcaatatagcaatgtgcaagaagatagagattttcaaaattcacttaagagtatctgagcataaaatgttaagattgctgatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgctccgtcgaagaggacgaccatccccgatagaggaggaccggtcttcggtcaagggtatacgagtagctgcgctcccctgctggaacctccaaacaagctctcaagattgctgatctagggccactaagtgatgaagcaaaaaggatggctaaaaaggacctcaacccttttgactttaaaaggaaaatagcttaaccttcaacctgtgtgacatttaactttttgaacccaaccgtaaaagctatcttctaaccaacaaaaagttaataattacatttggaattatacagaattagaaaattggcatttaaaaatactcaataatttgtccctggtttttaattttcaaaatattttctttttgaagagccagattccagtgatcctgcctctcagaaatttccacatttcttatttttcattaggccttaagaagctgcatttgtaaacttgtgtttcattattaaagcttaatttattttttatataaatagtatgtgctttgtgtacatagagaattaagtgaatgagtcacacagatgttggctgttgttaatgtgaaaattaaacagctgtatcacattttgaaaaataaaagtttcatctgaatgaatataaaa

SEQ ID NO: 399 - DNA, 2521 bp, Homo sapiens
  misc_feature: Incyte ID No: 209279.1
aaaaaatatgtcactgacacataacaaatgagggcagaaatggcattgttcccatctggggaagagcctcaagggtgggcagtatacaaaacatgaccctttgccagattctaactggtccagtgcccaatcccattgatagaaactcaaccaatgcaaacctcagcctgcaagctccgaaggggcagagtgcaagccggtagcttttgcctcctggagcccacagtccagatggggacaaaaaaagagatagggacacaaagagtgatcactgagccagagggtggaaaggtgcttaggagacatgagctgcttggaggcagagtcctgcttggaagctgttggttgattcctgggcaagccacttcccctcctgggcctgggttttcatctgtaaatgaaggcgtggatccagatctccctctaagactactccacgcctcacgtgccatttgttctctgagtttcccatgttctcgcctcctactacctagccctatgctaggactctcccctccaggacacagtagccagcctagctttcccctccccacctgcctctaacaatgggaaacaggcaggtggtaaacaggtgggcagtggaggtggccccatgtctccagcctcccctggaagctcccacccccctcattgttcagtgctctggtcctcctggagtggagacctgcagggcccctccccttcctctgttgacctctcctcactctccaggtgccagttttgctccctgcctcagcctggtttacatacagtgtatgtgacggggcttggtcactgctggggcagccctgtggaaggtggaggggaccgagcatgcatgagcttcaggctgagacagtcccagctcagaaccctggagtgcttgttccctccctttctgctcttcctcttccattgcacccactggacccaagagcatgcaaggattgactcacccagtgatgctagaactatgtattcatgctgaaagtaagggggtgggggcatccaaccaggggcagaagatgggaattcaagaaaggaaggtttcccctagaaaacggttttcgtcttttctcttaaatccagatagaataagaagcgaaggccgttacagcagagagaaagttgagtcaagcagagatcagatactaaagacactagactaaccagacattcgggccctcagttgaacagctgaggatgtcagaagatgttaaggaggcaaaattggaaaacttggtggctggcagacagaaatggggggagatgggagcagatgtgagaagatttaaaggcttgtagagcttgggtggtgatttcatccaccaaacctatctctctccccattctggcatacaaggcagcagtcagggtccccagaggcagcccatctttctggcagggacccatgctggagatctggccagctgaaaggccccaaaggagctcggtgccctgggtaatatgggaaggtgctccatggcactgccctcacatggaggccacagaagcccctgaatggctgctgcaattggtaacggggacacctgttcaactgaaatatctcctaccctgagatgggtcctttctccaagggatctttacaattacatttgtccccagtcattccatgttgggaggctgcagggaccagagaagctgagatggtctttggggaggggaaaggaaagatggacagttattttggtcctagaaagcccaaaggtggggaagtgtcaagaaggaagatgagggcacaagagaatgtagggccacccagaagctggctctcattgcaattacagaaagaaaaaccaaaataagaaagaaaggaaagaagctcccatttattgagcagctactctcaccagccattcacatgcaatacctcgtttaattctcgcagcggctctgaaaggtggatggtggtattgccatttgttaggtaggagacatgccgtccagaaaagcaaataattaaacattcaaagttgacctgggcccatttgaaaattccttttgctccctcattttaacccctaaagtaaagccgtttgtgactttatgagcttttaccaagcatctcctaaaaccaagaatggaggtgaaagattgtggagcccacaacctagagaaaggattgacaattttttttccataaagggcctagtagtatgtattttaggctgtgtggtccacatgagggcagattcttctttttgacttcctcctctgcatcttcttcatcttctctttcctcttcattttttttacaacctttgaaaaatataagcaccattcttagctttaggtacacacaaaaataagctatggctgtattggcttacaggctatagtttcctgacccctgttctaggggaggaaaataattgtacccaactaaatgcgtgcgaatcatgggcctatgtcatgattcccaaagaatgagtttcatggaattttcaacattttaaatattttactccattcttcccttgcttgcatagtttctgatgag

SEQ ID NO: 400 - DNA, 517 bp, Homo sapiens
  misc_feature: Incyte ID No: 381058.1
gctcgttgtgggcgggggcgggacgactagcccgttacacgcgggcctgagggacagactgtacactgggggcttgccgtttgaggaggatggttaagatagctaagtccttgggtagcgccagtgccaaataacccgttcgcctttttttctctgaaaatgttcccccaaaatggaggatttcgcagactctgaagagcctgcttgtttgagcagcgtttctttcttttcccggtgtctcggccttcacgccgctccttgcccatcgcctcagagcgccccctaagactcccggcccacacgcgcgcgcgcgcggcgttagctggacatcagaaacaattcctccccgccccccatcgcgtaaaaatggccgaaaaatgaaacgttaacgcttgtttttcgtactgcgtcgtggaacaagccgcctgcagtacagtgcgaggcgggtgatttgcacttgtttagtcaagtcacctcacatcctttttctctttatcaaaatagtattagtccagag

SEQ ID NO: 401 - DNA, 574 bp, Homo sapiens
  misc_feature: Incyte ID No: 046977.1
ccggatcctctagagatccctcgacctcgacccacgcgtccgaaaaaaagcactttttaagtcacctcgacttctttaggcaaaggcctgtctctgtagcagctcagagaggagtgtccaaatgccatgcaatgaaatggcagcatcgtttcttttctgcagcttcttgggcagatctttaaatgggcaaagtgaccaacaaggtgggtgggcaggtgagaggatgtgcttgctgcctctccagaacctggtctccatcctggtgtctacattttcccctttccctgcttgctctacacaggagtacttttctcaccgggtacttgtttggtgacctggagtgtgaggcagtgaatttcatgctgctttcagggcccagtagacaggcagttcagtagaggccaagaggtaaactggcagccaggtacagtgagagggaagccttgacctggcagcctgtgataaccggactggaaggctgggcatcataatagtctcagggctgccagcatcacctttggcactggtagctgcttgtgcatccaggaggaaggcctgttaggcagctgctgcc

What is claimed is:

1. A composition comprising a plurality of cDNAs, said plurality of cDNAs comprising a sequence selected from SEQ ID NOs: 32, 186, 308, 323, or their complements.

2. The composition of claim 1, wherein said plurality of cDNAs comprises SEQ ID NO:32.

3. The composition of claim 1, wherein said plurality of cDNAs comprises SEQ ID NO:186.

4. The composition of claim 1, wherein the cDNAs are immobilized on a substrate.

5. A high throughput method for detecting differential expression of one or more cDNAs in a sample containing nucleic acids, the method comprising:

(a) hybridizing the substrate of the composition of claim 4 with nucleic acids of the sample, thereby forming one or more hybridization complexes;

(b) detecting the hybridization complexes; and (c) comparing the hybridization complexes with those of a standard, wherein differences between the standard and sample hybridization complexes indicate differential expression of cDNAs in the sample.

6. The method of claim 5, wherein the nucleic acids of the sample are amplified prior to hybridization.

7. A high throughput method of screening a plurality of molecules or compounds to identify a ligand which specifically binds a cDNA, the method comprising:

(a) combining the composition of claim 1 with the plurality of molecules or compounds under conditions to allow specific binding; and (b) detecting specific binding between each cDNA and at least one molecule or compound, thereby identifying a ligand that specifically binds to each cDNA.

8. The method of claim 7 wherein the plurality of molecules or compounds are selected from DNA molecules, RNA molecules, peptide nucleic acid molecules, mimetics, peptides, transcription factors, repressors and regulatory proteins.

9. An isolated cDNA selected from SEQ ID NOs:32, 186, 308, and 323.

10. A vector containing the cDNA of claim 9.

11. A host cell containing the vector of claim 10.

12. A method for producing a protein, the method comprising the steps of:

(a) culturing the host cell of claim 11 under conditions for expression of protein; and (b) recovering the protein from the host cell culture.

13. The method of claim 5, wherein the sample is from liver, and differential expression is diagnostic of hyperlipidemia, hypertension, type II diabetes, or a liver tumor.

* * * * *